United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 4

SEQ ID NO: 2848 - DNA, 3028 bp, Homo sapiens
ggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcac

SEQ ID NO: 2849 - DNA, 2774 bp, Homo sapiens
acgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcct

SEQ ID NO: 2850 - DNA, 3047 bp, Homo sapiens
cggagggtgcgggtttggctgcggtggtttctgtggcggttgctgtggcggagtttggaggttggagagaaatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccgaggacgaagtgtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcacatctagactttgagttccctgcatctgccaccgtagtttctagcaggagtagtggggggagtaatacagattcttccctagaaggggacactggtaacatgtcccactcttggattagcaggggtgggtccaggaagatgatatttgcgtcttttgcccacccccctggcattcagctggacccaactaggccatcatgagtggcttctccctgtcatccccaggggtcataggatatctacaccgcctttctgaccccaccctgcactcccatcctttcctctctccccgttcatgccctgcactacatagcacagccgggatgcttggaacagaggccttggctgctccgcagtgcacagggcttccctctctcggggttggcttcttcccaggccttgcatgggccctgcccacaagcacaccctcaggccgagggtgcagactgatgctcttccctgatggagaccctgagatcttccccacccccaatcatgatgtcttcagtgtgggactggggtcctcttggttctgcctgcagcctgcctggctccgcccctagtgccccctcctcaccacactggccccaggtctcaggaggggtgtcctgggcagggaaggtcagtgtcactgatggtttgctgtttggaagccattggcagggctgccgtgcatgtggctgtgagggctgcacagtcctgccaaggggcttcctccttgtcaccccgaaccttgtaatcgtgtgctggcgtggcagccctggctaagttaatccccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcagggaaccctgcccaaggtcctcctgttcagacattcctatgttgaataaagtatgtttgacttccccgg

SEQ ID NO: 2851 - DNA, 3046 bp, Homo sapiens
ggcggcgcaggggcggggctttacggacgcaagcacgtcgaagcgctgctcctggagccgcggagggtgcgggtttggctgcggtggtttctgtggcggttgctgtggcggagtttggaggttggagagaaatccaggtactcactagactggtaccttctgccaccatgggggagcttttccggagtgaagaaatgacactggcccagctttttctacagtcagaggctgcttattgttgtgtcagtgaattaggagaacttggaaaggttcagtttcgtgacttaaatccagatgtgaatgttttccaacggaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattgaaaatgaactgaaggaaatcaacacaaaccaggaagctctgaagagaaacttcctggaactgaccgaattaaaatttatacttcgcaaaactcagcaattttttgatgagatggcggatccagacttgttggaagagtcctcatccctcttggagccaagtgagatgggaagaggcactcctttaagacttggcttcgtggctggtgtcattaaccgggagcgcatccctacttttgagcgcatgctttggcgggtatgccggggaaatgtgttcctgcgacaggctgaaatcgagaaccccctggaggatcctgtgactggcgactacgtgcacaagtctgtgtttatcattttcttccaaggcgatcagctgaaaaacagagtcaagaaaatctgtgaagggttccgagcctcactctatccctgtcctgagacaccacaggagaggaaggaaatggcttctggagtgaataccaggattgatgatctccaaatggttctgaatcaaacggaggatcaccgccagagggttctgcaggcagctgctaagaacatccgtgtctggttcatcaaagtgcggaagatgaaggccatctatcacaccctgaacctgtgcaacatagatgtgactcagaaatgcttgattgcagaggtctggtgccctgtcaccgaccttgactccatccagtttgcactcagaaggggcacggaacacagtggttccactgtaccttccattttgaacaggatgcagacaaaccagactcccccaacctataacaaaaccaacaagtttacctatggctttcagaacatagtagatgcttatggaattggaacttaccgagagataaatccagctccgtatactattatcacgttcccttttctatttgctgtgatgtttggagacttcggtcatggcattttaatgaccctttttgctgtgtggatggtactgagggagagccggatcctttcccagaagaatgagaatgagatgtttagcactgtgttcagtggtcgatacattattttattgatgggtgtgttctccatgtacactggcctcatctacaatgattgcttttccaagtctcttaatatctttgggtcatcctggagtgtacggccgatgtttacttataattggactgaagagacgcttcgggggaaccctgttctacagctgaacccagccctccctggagtgtttggtggaccatacccttttggcattgatccaatttggaacattgctaccaataaactgacgttcttgaactcctttaagatgaagatgtctgttatccttggtatcatccatatgctgtttggagtcagcctgagtctgttcaaccatatctatttcaagaagcccctgaatatctactttggatttattcctgaaataatcttcatgacctctttgtttggctatttggttatccttattttttacaagtggacggcctatgatgctcatacctctgagaatgcaccaagccttctgatccatttcataaacatgttcctcttttcctacccagagtctggttattcaatgttgtattctggacagaaaggaattcagtgtttcctggtagtggttgcactactgtgtgtaccttggatgctgctgtttaaaccattggtccttcgccgtcagtatttgaggagaaagcatttgggaactctcaactttggtgggatcagggtgggcaacggaccgacagaggaggatgctgagattattcagcatgaccagctctccacccactcagaggacgcagacgagccttccacctcgggacagtttgactttggggacaccatggtccaccaggccatccacaccatcgagtactgcctgggctgcatctccaacactgcctcctacttgcggctctgggccctcagcctcgctcatgcgcagctgtctgaggtgctttggaccatggtgatccacatcggcctgagcgtgaagagcttggcgggaggtttggtgctgttcttcttcttcactgcctttgccaccctgaccgtggccatcctcctgatcatggagggcctctcggcctttctccacgcactgcgcttacactgggttgagttccagaataaattctacagcgggaccggtttcaagttcttacccttctccttcgagcatattcgggaagggaagtttgaagagtgagtccctgtgagggccgtgtgccccatgctaccctccccgcctccctccacagtgatcagctgtgcctctctgcctgttggttgtgatctgtgggcaccagctcattcgtgtcaccctgtctgtgagtcatttagatagaatagtcctccttgggtctcccaccacccctagctttgtgtgtagtgtagtgattttctggctgtcactcatactcactgggcaccagccttgccctcttagcctccatccatccagacagcccttcccacctcctggtggtgagccagtctgcattcccacgccatcccaaagccctttcatcttccccgtgcattgtagatggaaggagcacccatgccattcac

SEQ ID NO: 2852 - DNA, 5789 bp, Homo sapiens
gggggcggaaccggaaccggcagtggcttgggggcgggacctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgcgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagtgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcgagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccagctctctttaccatcatcaccttcccgtttttatttgctgtgatgtttggagacttcggacatggctttgtgatgtttttatttgccctcttgttggtgttaaatgaaaatcatcccagactaaatcagtcacaagagatcatgaggatgttttttaatggccggtacatcctcctgctgatggggctgttctcagtgtacactggcctcatctacaacgactgcttttcaaagtcagtcaacctgttcggctctgggtggaacgtgtcggccatgtacagctccagccacccacccgcagagcataagaagatggtgctttggaatgacagcgtcgttagacacaacagcattttgcagctggatccaagcattcctggagtgttccgaggcccttatccccttggcattgatcctatttggaacttggccacaaatcgcctcacttttctaaactctttcaaaatgaaaatgtccgtgattttaggaatcattcatatgacttttggagtcattctgggaatatttaaccacttgcacttcaggaagaagttcaacatttacctggtttccatcccggaacttctcttcatgctctgtatctttggataccttatatttatgattttctacaagtggctggttttttcagcagaaacctccagagttgctcccagcattctgattgaatttattaacatgtttttattcccagccagtaaaacaagtggcctttacacagggcaggagtatgtccagagagtgctgctggttgtcacagcattgtctgtccctgtcctcttcttgggaaagccactgtttttgttgtggcttcacaatgggcgtagttgcttcggggtgaaccggagtggctacacacttataaggaaagatagtgaggaagaagtttcattgctgggaagccaagatatagaagagggaaatcaccaggtggaagatggatgtagagaaatggcgtgtgaagagtttaattttggagaaatattaatgacccaagtaatccattccatcgagtactgtctgggatgcatctccaacaccgcctcctacctgaggctctgggcgcttagcctggctcacgcacagttgtctgatgtcctgtgggccatgctgatgcgcgtgggcctccgcgttgacaccacctatggcgtcttgctactgctcccggttatcgcgctctttgcagttttgaccattttcatccttctgatcatggaagggctttctgcgtttcttcacgccatacgcctccactgggtagaatttcagaacaaattctacgttggtgcaggcaccaaatttgttcctttctcattcagtctactttcatcaaagttcaataacgacgacagtgtggcatgatcatattgctgtaaccaacaagctttcagatttatggagaatgaccatgttatagactttcacttatgtcagatttatgataggaaaaattccatcttcattactgccttatgacatagccaaataattctgtaagatatacctcttcctcatatgttaaatattttgtaaagtttaccaatttgagatataaaaatttcttttggttttttatgatgagcaaatataagttaatgccaaacgttatgttaaagttattttttcaaatacaggatttggggagagaagccaattttgcatggctagttgaaaatggtattagatacttatttcctttaaactttatttaaaacaaacaacagagttaatctgtcacctgaagttgccagataatattttccaacagctgaagtagggatagttttttaaaaaatttaatgatgggtaatcaaaacattcacatttattctgctggatttaaaaatatgtactttttttttttttttgagatgaagtcttgctgtgtcacgtaggctggagtgcaatggcacgatcgtgtctcattgcaacttccgcctcctggattcaggtgattctcctgtctcagcctcccgagtaactgggattacaggcatgcgccaccgtgaccagctaatttttttgtatttttgtagagatggggtttcaccatgttggccaggctggtctcgaacttctgacctcaagtgatccacctgcctcggcctccctaagtgctgggattacaggcgtgagccaccatgcctggccaaaatatgcaaatattttttatcctgtgctacctagaattacaagtagaggattgtttttacaattttgtcttgttttagtaattggggacaatgggataaaatgacatacaacaaatggttatcccacttgtatatttttttaaagactcttatcctgttacccttacataaaaccagttatgataattgtatgtttggaagataaattgtatgctgagccttaaaacccagtgtgactgtagaagatataatgcggacatgatttgaatttagtgacagcttggctgatgtcactgaaccagaagggtttatactgagtgaaggaaaggtaaaaagtagtattttgtatatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcagctgatttcaaggcatgagctgaacagcgttgacacagccgtgacttacaattaaaccctttcaattacagtacagattctgtgtgctacttgatgagatgttacccaaggccagtttggacttactgctttttgtccctcatattaaattatcaaatgatgccgatgaaatgcttgaaaatgattctgctctcaaagttatgcttccctagaaaggtgtcatgtcgggcacttgtgttgggtgactatgacatcccagcagtgctggtcaggtctcagagttgctttcacctagagctgatgcttccacaaggggacatttgtgttactttgctccaggggtctgtcataaaaacaatggtaactacttcatccctaggaagcccaagacttcagggcactgttagctgattggtaaataagggacacgatattcacgggaattgtttactgctccccactagtaattctcatggggccacttttttaactctttctaattaacacctcttctcagcatagagcagaggatgcagtcatttctctgttgaaatctatgtagtatttatgtagaatgtcattatatgaaaagcgaattcagaatcctaactctgggaaagcgctctctggaaatgtagtttgataatagtgtcttataggggccacgggaatttgtttctctataaagcgatgggctccagtgtcatgttaccagagttatcgctcagttttgtttgttaaggcttttgctagaacctattatgtatccagtttttaaaacatacttcattcccttgatagcagagatccagagcacagatggcaagttgtgtggatgatactgaatatgtttattttcctaaagataaatgtcacgacacgacatttctcagtttttatttagatgtttattaccatgtgttaacagaatcttaaaacccaagggatttcttcagtaaactagactttgattcaacctgctgggctggagactgtaattgccgtggtcagttaaggagtgcaaagggtgttctgtctgataggatctgggtgagccctgcggactttccagcagcgaaaggacttggaactcctctttcgctgaatgctgctctgtttctggaatggatattttataacaacattctggtgtcagcatcccctcagcagttgtttatttaaaaatttttttattttttttgagacagtgtctcactctgtcacctaggctgaagtgcagtggtgcagtctcggctcactgcaacctctgcctcctggg

SEQ ID NO: 2853 - DNA, 1620 bp, Homo sapiens
acctcgcggactgctgtggcggcagctggagcggcggccgcggtggcagaaccgggggcggccgctgcagtctggagccccatagtgcggggccgcggccaggccacaggaagagctcgaggcccgggccgcaccggctgagtgtgcgggcccgcgcggctcggagccgccgccgcccatcgagcccctccgggcgcgggtcggcccgccatggggtccctgttccggagcgagaccatgtgcctggcgcagctcttcctgcagtcgggcacggcctacgagtgcctcagcgccctgggcgagaaaggcctggtccagttccgagacctcaaccagaacgtaagttctttccaaagaaaatttgttggtgaggtgaagaggtgtgaagagctagagcgaatattggtgtatttggtacaggaaattaatagagctgatattccccttcctgaaggagaggccagccctcctgcgccacccctgaaacaggttctagaaatgcaggagcagttgcagaagctcgaggttgaactgagagaagtcactaagaacaaggagaaactgaggaaaaacttgctggaactgatagagtacactcacatgctgagagtgacaaagacctttgtgaaacgcaatgttgagtttgaacccacttatgaagaattcccttccttagagagtgattctttgttggattacagctgtatgcagaggctgggagcaaaactgggatttgtgtctggcctaattaaccaaggaaaagtggaagcatttgaaaaaatgttgtggagagtctgcaaagggtacaccatcgtgtcctatgcagaactggatgaatcccttgaagaccctgaaacaggggaagtcataaaatggtatgtctttttaatatccttttggggagagcagattggccacaaggttaagaagatatgtgattgctaccactgccacgtgtacccctatccaaacacagccgaggagcggagggagatccaggaggggctgaacacccgcatccaggatctctacactgtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcggtaaggctgccttcctctcctctgccaggaacagaagagagactgatggaactgataaattcagagaaaaaaaggaagtgagaatttcatagagtaatgagaatgcagtgtgttgactcttcttttgtttttttaaaatattaattaacaaaattaaaatagagatggggttttgctgtgttgcccaggctggtctcaaactcctggccccgagcgatcctcctgcctcagccttggctctgtttttgaactgaaattatggtgagctggtcattcaaagctgtatgtgagtacatgtgtttttaaattgctcttttgagtaattcattcacatggtgtaaaagtgaaaagaaataaaagagtatgaaagac

SEQ ID NO: 2854 - DNA, 3135 bp, Homo sapiens
ataacgctacctgccgagcaagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcagtctcatttccagttcctccatgacgtggcaagtgaagacaggaatgaaaggaatgtaaagcagcttttctctgaagagaagaagagagagagacacagccaagaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattc

SEQ ID NO: 2855 - DNA, 2709 bp, Homo sapiens
gctggaggctgtgctgagtgcccggtgcaggtgagccggtcctgcggagttgtgccgagtgcctgctgcagaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggtt

SEQ ID NO: 2856 - DNA, 3090 bp, Homo sapiens
aacagagctgcctcctggctctttgggagcctgggaggagaaggagccgggaggggcgctgcggggaagccacctgcggattcactggctgctgctccgcccaggactgctagcaagcacggagggctgccagacctggggctccctgctccgtgcgtcaggttggggaaaccaccgtctgccccagaccctgacccaggacccgcctggaggaagctgggaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattc

SEQ ID NO: 2857 - DNA, 3558 bp, Homo sapiens
gttgggtgggagcacaggcaccgggcaccatggggaaggccgagaactatgagctctactcggtggagctgggtcctggccctggcggggacatggctgccaagatgagcaagaagaagaaggcgggtggcgggggtggcaagaggaaggagaagctggagaacatgaagaaggagatggagattaacgaccaccagctgtcagtggcggagctggaacagaaataccagaccagtgccaccaagggcctctctgcgagcctggctgctgagctgctgctgcgggatgggcccaacgcactgcggccaccacggggcaccccagagtacgtcaagttcgcgaggcagctggccgggggcctgcagtgcctcatgtgggttgccgccgccatctgcctcatcgcctttgccatccaggctagtgagggggacctcaccaccgacgacaatctgtacctggcaatcgctctcattgctgtggttgtcgtcaccggctgctttggctactaccaggaattcaagagcaccaacatcatcgccagctttaagaaccttgtgccacagcaagccactgtcatccgcgatggagacaaattccagatcaacgctgaccaactggtggtgggcgacctggtggagatgaaaggtggggacagagtgcccgccgacatccgcatcctggcggcccagggctgcaaggtggacaactcctcgctgacaggggagtctgagccacagacccgctcacccgagtgcacgcacgagagccctctggagacccgcaacatcgccttcttctccaccatgtgccttgagggcaccgtgcagggcctggtggtgaacacgggcgaccgcaccatcattgggcgcatcgcatcgctggcgtcgggggtggaaaacgagaagacacccatcgctatcgagatcgagcattttgtggacatcatcgcgggcctggccattctcttcggtgccacattttttattgtggccatgtgcattggctacaccttcctgcgggccatggtcttcttcatggccatcgtggtggcctatgtgcctgaggggctgctggccactgtcacagtctgcctgtccctgacagccaagcgcctggccagtaagaactgcgtggtcaagaacctggaggcggtggagacattgggctccacttcggtgatctgctcggacaagacagggactctcactcagaaccgcatgactgtgtcccatctgtggtttgacaaccacatccacacagctgacaccacggaagaccagtcagggcagacgtttgaccagtcctcggagacgtggcgggcgctgtgccgggtgctcaccctgtgcaaccgcgccgccttcaagtccggccaggatgcagtgcctgtgcccaagcgcatcgtgattggagacgcatcggagacggcgctgctcaagttctcggagctgacgctgggcaacgccatgggctaccgggaccgcttcccaaaagtctgcgagatacccttcaactccaccaacaagttccagctgtccatccatacgctggaggacccgcgggacccgcgacacttgctggtgatgaagggcgcccccgagcgcgtgctggagcgctgcagctccatccttatcaagggccaggagctgccgctggacgagcagtggcgcgaggccttccagaccgcctacctcagcctgggaggcctgggcgaacgcgtgctcggcttctgccagctctacctgaatgagaaggactacccgcctggctatgccttcgacgtagaggccatgaactttccatctagcggcctctgctttgcgggacttgtatccatgattgacccaccccgggccaccgtccctgatgctgtgctcaagtgtcgcaccgcaggcatccgggtgatcatggtaacgggtgaccaccccatcaccgccaaggccattgcagccagtgtgggcatcatctcggaaggcagcgagacagtggaggacatcgctgcccgcctccgtgtgcccgtagaccaggttaatcgcaaggatgcccgtgcctgtgtgatcaatggcatgcagctgaaggacatggacccatcggaactggtcgaggccctgcgcacccaccccgagatggtgtttgcgcgcaccagcccccagcagaagctggtgatcgtggagagctgccagcggctgggtgcgattgtggccgtcacgggggatggtgtgaatgactccccagctctgaagaaggcagacatcggagtagccatgggcatcgctggctcagatgctgccaaaaatgcagctgacatgatcctgctggatgacaactttgcctccattgtgacaggcgtggagcagggtcgactgatcttcgacaacctgaagaagtctattgcctacacattgaccaagaacatcccagagctgacaccctacctcatctacatcaccgtcagcgtgcccctgcccctcgggtgcatcaccatcctcttcatcgaactctgcactgacattttcccatctgtgtccctggcatatgaaaaggccgagagtgacatcatgcacctgcgtccacgcaacccaaagcgtgacagattggtcaacgagcccctggctgcctactcctacttccagattggtgccattcagtcctttgctggcttcactgactacttcacggcaatggcccaggagggctggttcccactgctgtgcgtggggctgcgggcgcagtgggaggaccaccacctacaagatctgcaggacagctacggccaggagtggacattcgggcagcgcctgtaccagcagtacacctgctacaccgtgttcttcatcagcattgaggtgtgccagatcgccgatgtcctcatccgcaagacgcgccgtctctctgccttccagcaaggcttcttcaggaataagatcctggtgatcgccatcgtgttccaggtctgcatcggctgcttcctgtgctactgccccggcatgcccaacatcttcaacttcatgcccattcggttccagtggtggctggtccccctgccctacggcatcctcatcttcgtctatgatgagatccggaagcttggagttcgctgttgcccagggagctggtgggaccaggaactctactattagagggacgactgccttcaagcatccctgcaactgccacagcaggtgggggcagggctcgtgggaccctctggacagccaccaagatatctgagcaaccaagagtcccagccccaccagtatctgcttctgtagcccacggcaccccaaacttggagggacctgcccactcccctcccccattcccaaggttcgcacctcctggagcagcagcgcctgggcagtcctctgggctggcctcgggaaagccgccacctgtggtggcggtggggctctgacagggagtacagctgaccgcttctggagggtgtttctgttcttaggactccagtccaggctggacggctgcctgagggcccttcgttaaagacacgcttgtgtcctgggcgatggtaataaaaccagctcatgctgactgtgctgt

SEQ ID NO: 2858 - DNA, 1434 bp, Homo sapiens
gagggtgcagggagcagacgggaggatctcaggccagggacgatggcggctctgcaggagaagaagacgtgtggccagcgcatggaggagttccagcgttactgctggaacccggacacggggcagatgctgggccgcaccctgtccaggtgggtgtggatcagcctgtactacgtggccttctacgtggtgatgactgggctcttcgccctgtgcctctatgtgctgatgcagacagtggacccgtacacaccggactaccaagaccagctacggtcaccaggggtaaccttaaggccggatgtttacggggagaaaggcctggaaattgtctacaacgtctctgataacagaacctgggcagacctcacacagactctccacgccttcctagcaggctactctccagcagcccaggaggacagcatcaactgcacctccgagcagtacttcttccaggagagtttccgcgctcccaaccacaccaagttctcctgcaagttcacggcagatatgctgcagaactgctcaggcctggcggatcccaacttcggctttgaagaaggaaagccatgttttattattaaaatgaacaggatcgtcaagttcctccccagcaacggctcggcccccagagtggactgcgccttcctggaccagccccgcgagctcggccagccgctgcaggtcaagtactaccctcccaacggcaccttcagtctgcactacttcccttattacgggaagaaagcccagccccactacagcaaccccctggtggcagcgaagctcctcaacatccccaggaacgctgaggtcgccatcgtgtgcaaggtcatggcggagcacgtgaccttcaacaatccccacgacccgtatgaagggaaagtggagttcaaactcaagattgagaagtgaaacggtttgcgcaggggtcctgggcacgcctgcggggtcgctcaaggacaccctcctggttgggcttaccttgcccgtcagttccctgccaaatcatccccaaagtggtttggagcaacggtgttgtcagtgtgcgaactccagagaagcgcccacatctgaaggacctgctcgcgagtatcagttcttccttgttgaattcttacagtttttagatggaatttgctgctataagaatgtccagctaccatgggaacgcaaggcagcaactctctaattaaccaggtcataaaaacgattcgtcttctatgtagacatcactttcttactataatttatttttctacacttcaatatgaactgccccccccacattaatataaaaactactaatgcactgatatgaaacacggcttacactaatgacattctgaattcttgcttttaaaattgcaattcctaagttgtaaacataaaatatattaaagttactcttattgtatgtaaaaaaagaaa

SEQ ID NO: 2859 - DNA, 3732 bp, Homo sapiens
aatcctggactctcccgacccctagctgtcggtccccctccctgcgcgcgcgccggcgggtttcctaccctccgaggcgtccgctggcctgcgccctggcggggacgtgggcggggcgggcggcatttaaggctggtgccacctccccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggatgaccacaaactcagcaatagggaattggaagagaaatatggcacagacatcattatgggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtgtacttgggctgtgtgcttggtctggtggtcattttaacggggatctttgcttattaccaagaggcaaaaagcaccaacatcatgtccagcttcaataagatgatccctcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtggataactcatctctcacgggggagtctgagccccagccccgctcctctgagtttacccatgaaaaccccctggaaacaaagaacatctgcttctattccacaacgtgtctggaagcatctacttcccctgtaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaaaccaagtctttgaccaaagctctaggacttgggcctccttatccaagataataacattgtgtaaccgagcagagttcaagccaggacaggaaaatgtccccatcatgaagaaagctgtgattggagatgcctcagaaactgctcttttaaaattctcagaggtcattttgggtgatgtgatggaaattagaaaaagaaaccgcaaagtagctgaaatcccttttaactctactaataaatttcagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggttattatggttactggtgatcatcccatcacagccaaagctattgccaagagtgtggggatcatttcagccaacagtgaaacagtggaagacattgcacatcgcctcaacattgctgtggagcaagttaacaaacgggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattatcccctccattgccttggcgtacgagaaagctgaaagtgacatcatgaacaggaagcctcgccacaagaataaggacaggctggtgaaccagccgctcgctgtgtactcatacctgcacattggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatggacaaggtaccagagggaatacctagaatggacgggctacacggctttctttgttggcatcctagtccagcaaatagcagatctgatcatcaggaaaacccggaggaattccatcttccagcagggtctcttcagaaataaagtcatctgggtggggatcacctcacagatcatcattggtctgatcctctcctatggcctcggaagtgtcacagccttgagtttcaccatgcttagggctcagtactggtttgtggctgtgccgcacgccatcctgatctgggtgtatgatgaggtgcggaagctcttcatcaggctctaccctggaagctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtataggg

SEQ ID NO: 2860 - DNA, 3538 bp, Homo sapiens
cggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggatgaccacaaactcagcaatagggaattggaagagaaatatggcacagacatcattatgggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtgtacttgggctgtgtgcttggtctggtggtcattttaacggggatctttgcttattaccaagaggcaaaaagcaccaacatcatgtccagcttcaataagatgatccctcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtggataactcatctctcacgggggagtctgagccccagccccgctcctctgagtttacccatgaaaaccccctggaaacaaagaacatctgcttctattccacaacgtgtctggaaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaaaccaagtctttgaccaaagctctaggacttgggcctccttatccaagataataacattgtgtaaccgagcagagttcaagccaggacaggaaaatgtccccatcatgaagaaagctgtgattggagatgcctcagaaactgctcttttaaaattctcagaggtcattttgggtgatgtgatggaaattagaaaaagaaaccgcaaagtagctgaaatcccttttaactctactaataaatttcagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggttattatggttactggtgatcatcccatcacagccaaagctattgccaagagtgtggggatcatttcagccaacagtgaaacagtggaagacattgcacatcgcctcaacattgctgtggagcaagttaacaaacgggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattatcccctccattgccttggcgtacgagaaagctgaaagtgacatcatgaacaggaagcctcgccacaagaataaggacaggctggtgaaccagccgctcgctgtgtactcatacctgcacattggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatggacaaggtaccagagggaatacctagaatggacgggctacacggctttctttgttggcatcctagtccagcaaatagcagatctgatcatcaggaaaacccggaggaattccatcttccagcagggtctcttcagaaataaagtcatctgggtggggatcacctcacagatcatcattggtctgatcctctcctatggcctcggaagtgtcacagccttgagtttcaccatgcttagggctcagtactggtttgtggctgtgccgcacgccatcctgatctgggtgtatgatgaggtgcggaagctcttcatcaggctctaccctggaagctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaa

SEQ ID NO: 2861 - DNA, 3654 bp, Homo sapiens
ctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaa

SEQ ID NO: 2862 - DNA, 2595 bp, Homo sapiens
ggtaaagaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgaacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 2863 - DNA, 698 bp, Homo sapiens
caagagctgtaccgaaagaggcaccaacaaatgtggttgctccataatggagagaatgtcaagaatgttgactatctttagacctgcttcattaatagataagatagaaactaaagaacccacccagttggaagaagttattagtcaagtagtgctgcacacgtgaccacagaagttaaaaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtga

SEQ ID NO: 2864 - DNA, 3572 bp, Homo sapiens
gatatgtaataatgtctttgcaaagcaaagaatataaacagtataaaagtactagcatttagatgtattgtatcatttaatccttaaaaacatgaaatgaggttggcactattctttatctccacgctgtggaagaggaaattgaaatgtagaagttagtaacttgcctaaggatacactgctggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 2865 - DNA, 654 bp, Homo sapiens
agcgcccggggaggccatccgcaggtgggcgcggggcctggattccacagaggggcggagtccctcagtcaggcgctggctgcaatcacacccgagcgccagccccctccagcatccctgagtcccagaggagatcgccgaagcgctggaaaagccgttccgcccacgacttctggtgccgggtcggcggcgactgggggagcccagttccgagaccgtaccgcacccactgcggacctcctgggccctacatagttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcag

SEQ ID NO: 2866 - DNA, 579 bp, Homo sapiens
agacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaagactctgacgcagtacagttaatctgtgcacaggaaagaagagctgtttgaagaggttattcggtaaatgcagagaatgtctttgtagtataaattattgctctatataaaactgcttgtaagtttt

SEQ ID NO: 2867 - DNA, 3225 bp, Homo sapiens
ctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaagactctgacgcagtacagttaa

SEQ ID NO: 2868 - DNA, 3763 bp, Homo sapiens
agcagcgggggcggccccgggactgagccggcatccctgagcctggctcccctccctgcgaccgccgtcacctccttctccttccttttccctccgccctccgtgccctgaggaaaggcgcgctcctccccttcccctggggcgctccgccggggcctcctcccgggcctccgttcccgccgcggccccggttccggcgggggcagcctccgggttcggggctccttctcctggggacgctggggcttagcttgctccgcgcagaggcggccgccctcccccaaagaaaaaactggctgcttctaagtgcgaagccggctgggcgggctggtgccagaaagggtgtgtcttcactgccctaagatggcctttaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatgg

SEQ ID NO: 2869 - DNA, 5421 bp, Homo sapiens
gtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaa

SEQ ID NO: 2870 - DNA, 3338 bp, Homo sapiens
ccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaacctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtcc

SEQ ID NO: 2871 - DNA, 2308 bp, Homo sapiens
atgctcagctctgctctggccctctctggagctctagtcaaacgtcttaaaccccctaatgggcatttcatcttaacagatactcatgatctcaacacatctaaaattgaacattcattatttacagtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagca

SEQ ID NO: 2872 - DNA, 4413 bp, Homo sapiens
tccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaa

SEQ ID NO: 2873 - DNA, 945 bp, Homo sapiens
ctctgtctgccagggtctccgactgtcccagacgggctggtgtgggcttgggatcctcctggtgacctctcccgctaaggtccctcagccactctgccccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggtgattgggtgctccagagggggtggataggattagaggaggctgagggcagtggcgtggtggggtgagtggttgagataaaggctct

SEQ ID NO: 2874 - DNA, 3548 bp, Homo sapiens
ctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 2875 - DNA, 3418 bp, Homo sapiens
gtaggtgctgagccggctgggcgccgcttccgtgtgacattgtggggccggtgacattgggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagag

SEQ ID NO: 2876 - DNA, 3818 bp, Homo sapiens
gaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 2877 - DNA, 598 bp, Homo sapiens
gcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatggggtctggtggctctgacagctatcgtatcgccacctcgcaggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggct

SEQ ID NO: 2878 - DNA, 2428 bp, Homo sapiens
ttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccccggctgatgccatctctggttctggacaattatcaaatatatcagtggggagag

SEQ ID NO: 2879 - DNA, 3427 bp, Homo sapiens
gtgtgtgtgtgcagcccctcatgtaggggagcaggcatgggaggctgggaggaggagaggaacaggagagccacggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctgg

SEQ ID NO: 2880 - DNA, 3588 bp, Homo sapiens
agcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatggggtctggtggctctgacagctatcgtatcgccacctcgcaggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcactcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagag

SEQ ID NO: 2881 - DNA, 3839 bp, Homo sapiens
agcaaccacagggcctgggactggggggttcccagatccttgaagctcactccgcctcctcactctcactgcatttcccaccttcctgtgggccttgcggcatcttcatcactgaggcacctggttacgcttcacctcttgtttcctgccctcactgcattccctcacctctacctttttatccttccaccctaggcttctctcctccctcttccctcactcctgactcttcctcttcccagcggacggctggaggaccgctcagtctctcctctctcacttcccttcctctctctcaccttcaccacccaacacctccctccctgcctctttctttctgctccctcattctctccccaccactctcttctcgtggcccccttgcccgcgcgccctcttcccttccccttgcctcactctctcagctttcttcccacagttgagctcgggcagctctttctggggatagctatggggctttgggggaagaaagggacagtggctccccatgaccagagtccaagacgaagacctaaaaaagggcttatcaagaaaaaaatggtgaagagggaaaaacagaagcgcaatatggaggaactgaagaaggaagtggtcatggatgatcacaaattaaccttggaagagctgagcaccaagtactccgtggacctgacaaagggccatagccaccaaagggcaaaggaaatcctgactcgaggtggacccaatactgttaccccaccccccaccactccagaatgggtcaaattctgtaagcaactgttcggaggcttctccctcctactatggactggggccattctctgctttgtggcctacagcatccagatatatttcaatgaggagcctaccaaagacaacctctacctgagcatcgtactgtccgtcgtggtcatcgtcactggctgcttctcctattatcaggaggccaagagctccaagatcatggagtcttttaagaacatggtgcctcagcaagctctggtaattcgaggaggagagaagatgcaaattaatgtacaagaggtggtgttgggagacctggtggaaatcaagggtggagaccgagtccctgctgacctccggcttatctctgcacaaggatgtaaggtggacaactcatccttgactggggagtcagaaccccagagccgctcccctgacttcacccatgagaaccctctggagacccgaaacatctgcttcttttccaccaactgtgtggaaggaaccgcccggggtattgtgattgctacgggagactccacagtgatgggcagaattgcctccctgacgtcaggcctggcggttggccagacacctatcgctgctgagatcgaacacttcatccatctgatcactgtggtggccgtcttccttggtgtcactttttttgcgctctcacttctcttgggctatggttggctggaggctatcatttttctcattggcatcattgtggccaatgtgcctgaggggctgttggccacagtcactgtgtgcctgaccctcacagccaagcgcatggcgcggaagaactgcctggtgaagaacctggaggcggtggagacgctgggctccacgtccaccatctgctcagacaagacgggcaccctcacccagaaccgcatgaccgtcgcccacatgtggtttgatatgaccgtgtatgaggccgacaccactgaagaacagactggaaaaacatttaccaagagctctgatacctggtttatgctggcccgaatcgctggcctctgcaaccgggctgactttaaggctaatcaggagatcctgcccattgctaagagggccacaacaggtgatgcttccgagtcagccctcctcaagttcatcgagcagtcttacagctctgtggcggagatgagagagaaaaaccccaaggtggcagagattccctttaattctaccaacaagtaccagatgtccatccaccttcgggaggacagctcccagacccacgtactgatgatgaagggtgctccggagaggatcttggagttttgttctacctttcttctgaatgggcaggagtactcaatgaacgatgaaatgaaggaagccttccaaaatgcctacttagaactgggaggtctgggggaacgtgtgctaggcttctgcttcttgaatctgcctagcagcttctccaagggattcccatttaatacagatgaaataaatttccccatggacaacctttgttttgtgggcctcatatccatgattgaccctccccgagctgcagtgcctgatgctgtgagcaagtgtcgcagtgcaggaattaaggtgatcatggtaacaggagatcatcccattacagctaaggccattgccaagggtgtgggcatcatctcagaaggcactgagacggcagaggaagtcgctgcccggcttaagatccctatcagcaaggtcgatgccagtgctgccaaagccattgtggtgcatggtgcagaactgaaggacatacagtccaagcagcttgatcagatcctccagaaccaccctgagatcgtgtttgctcggacctcccctcagcagaagctcatcattgtcgagggatgtcagaggctgggagccgttgtggccgtgacaggtgacggggtgaacgactcccctgcgctgaagaaggctgacattggcattgccatgggcatctctggctctgacgtctctaagcaggcagccgacatgatcctgctggatgacaactttgcctccatcgtcacgggggtggaggagggccgcctgatctttgacaacctgaagaaatccatcatgtacaccctgaccagcaacatccccgagatcacgcccttcctgatgttcatcatcctcggtatacccctgcctctgggaaccataaccatcctctgcattgatctcggcactgacatggtccctgccatctccttggcttatgagtcagctgaaagcgacatcatgaagaggcttccaaggaacccaaagacggataatctggtgaaccaccgtctcattggcatggcctatggacagattgggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaattatcttggatgagaaagatgggcaatcctgggctggcttgagggaatcatgggcagaggatgaggtgggctgaagggaagcccagcctgcatctagctggagccccgcagggaggggcatggtcctgctgaatcccgtagccagtctagacagtaaatgtctggaaaagccctca

SEQ ID NO: 2882 - DNA, 886 bp, Homo sapiens
caccagcccagccagaagcaagtcccagcccccagccctcccctggcctaccttttggggcccttctctgaaccaggctcccctgtcctgcaactctgtcattcacagggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaattatcttggatgagaaagatgggcaatcctgggctggcttgagggaatcatgggcagaggatgaggtgggctgaagggaagcccagcctgcatctagctggagccccgcagggaggggcatggtcctgctgaatcccgtagccagtctagacagtaaatgtctggaaaagccctca

SEQ ID NO: 2883 - DNA, 1382 bp, Homo sapiens
tatttcagcctccatcctgttgtcttgttaactatgggaaaaagaaaatgcagcccagcaagtcagtcattattcttgttccagttccagaagatggaattaaaatttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatgg

SEQ ID NO: 2884 - DNA, 2589 bp, Homo sapiens
gccaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattc

SEQ ID NO: 2885 - DNA, 2608 bp, Homo sapiens
gcccacaaggggcacagccgggcagtcaggaaccggggctgccggctgggctggcctgcaaagaagagggaagggccggaactgcaaccgcagtggcggggagtgcgagggggcggcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattc

SEQ ID NO: 2886 - DNA, 1738 bp, Homo sapiens
agtcattcagggagtcctgaacagaggccgattggtgttcctgcttgggaggatctgtgggaatcggcaggagaatgagtcagggaaatagtgcttagctgacattttgaaatggaagaagctggaatatatgaatttttgtaaagaaaaaaaaatgcagcctttaagatccttctattctacgtaatattttatggctgcctggctggcatcttcatcggaaccatccaagtgatgctgctcaccatcagtgaatttaagcccacatatcaggaccgagtggccccgccaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcgatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaagcctcccaagaatgagtccttggagacttacccagtgatgaagtataacccaaatgtccttcccgttcagtgcactggcaagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctg

SEQ ID NO: 2887 - DNA, 3330 bp, Homo sapiens
ggagcggagcctccgcctggggggccccccatccctggctgtcccccagctgcgcgtccccgccccacccccgcggctgagccaccaccggtgcagtggtctccgcttggcggagcgagccttgagcttcgttccacagcttctttgcatcttggatttcggggcggccccctcccccacctctctctgcctttttgtaccccgctttttttctgcgttctgctcggtttttgtagccgtctgtttttgcaccccatttcgttttgtttctagacggtttggtggggggtgaagctgcattcataccccttcctcttgttattctcccctgctctgacagcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctccgcaaccccccgccccgcgcccggactcgccccgcgccaccaagatggtcatccagaaagagaagaagagctgcgggcaggtggttgaggagtggaaggagttcgtgtggaacccgaggacgcaccagtttatgggccgcaccgggaccagctgggcctttatcctcctcttctacctcgttttttatgggttcctcaccgccatgttcaccctcaccatgtgggtgatgctgcagactgtctccgaccatacccccaagtaccaggaccgactggccacaccgggcttgatgattcgccccaagactgagaaccttgatgtcattgtcaatgtcagtgacactgaaagctgggaccagcatgttcagaagctcaacaagttcttggagccttacaacgactctatccaagcccaaaagaatgatgtctgccgccctggacgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtcatcaacttctatgcaggagcaaaccagagcatgaatgttacctgtgctgggaagcgagatgaagatgctgagaatctcggcaacttcgtcatgttccccgccaacggcaacatcgacctcatgtacttcccctactatggcaaaaagttccacgtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacggaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctggccaccgtcccttgatctctcatactttctccctgtctacacagtcgccatcttggtgactttgaatttatctggctcctgggcaggtcttctcctcctctccatccctattccctcctctgaaatgcacccctttgtaattgaggacaaggtggttctgtggccttttccctctttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttctttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagctctgggggaggggcggccattctggctccgtccccagtggccaccttggaaacatcggctggctttgggactattccacctccttcccctgagcccagatctgcccccaccatcctttctctggcttcttttagcaagttatcaactaatcactaactccttccttttcctctgcatgccagcctgaaaattccaaatctagcctctgaatgtcttggctccatctcttcagacccctttgcctttaaaaaaaaaacaaaaacaaaaacaaaaaaacccataatgcccacagaatgtcaaatgaggggcctcctgcctcctgctctgaatattctgtagctgtagaggcattttaaccctttgtcctccagcatcccttcacttcctcatcctctctaacctcctttttctttttttaatgctgcagcctccacactccacccacaggtggacccttccctttttctctagctggatctgtgtttcttcccttcgggcccccatgttttcctgcacccgccctaccatggtctctctctgcagttatttaatgcctgtgtcagatctactgtaaaaagaggattaagtaaaataaaatgagagcaattatatatataaatatatatcatacacag

SEQ ID NO: 2888 - DNA, 1811 bp, Homo sapiens
ccaagcggccgcccggcgcggcgcggcgcagtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtgga

SEQ ID NO: 2889 - DNA, 1924 bp, Homo sapiens
agtcggctcgagtactccccgtaacgaggaggtgttctcggccgtcccacccttcactgccgtctccgggctgcgccgccggagccgggacgcgcctccgcagccctcgccgcctccatccccgcggccgcagctcctctcgccgtccgcgcgcacaccatgacgaagaacgagaagaagtccctcaaccagagcctggccgagtggaagctcttcatctacaacccgaccaccggagaattcctggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagacaaataatgtaaaagatggaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatat

SEQ ID NO: 2890 - DNA, 2234 bp, Homo sapiens
gctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaaggggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattcc

SEQ ID NO: 2891 - DNA, 2394 bp, Homo sapiens
ctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatctgaatgaccagcctgcagatatcagaaccgagatggattgatgatgatgacaatgataaccattcaggtataaaacattttcagtgcagc

SEQ ID NO: 2892 - DNA, 2587 bp, Homo sapiens
ctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgtgtgctgggtaaaccaggagaaagtaattgcagtcgagggctttgggaacagcacagttggccagagagacagatgaggaaaacaagcagggatgagagagaatgaagaggagcacggcaccccagggctggcttagtcctggcgccaggacttagtttactctgtcattgtttctttcccacattagagtttgtcttcatcactgctgtattccccagtgcctagaacagtggctgacacatagtatgtgctcagtaaacagccattaaagaaatgtttgagctg

SEQ ID NO: 2893 - DNA, 714 bp, Homo sapiens
agacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtagctgccatccctgggagcctggaaccaggcaatgttcgggggaggcaggggacaggctggaacctggtgaagtcttaaagtagactcctcctatcggggtgtagaagggaatctgttaatcaaacagagcaatattagaaaggctacagaggtcaactcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagagccacattaggatgaaccttttaaaaagttatgcatttatttttatgttcccccactggctgtattataggacaatttttatatgtgatatgtatttaccttagtgtgttaaataaacactggcattccaagtgtga

SEQ ID NO: 2894 - DNA, 923 bp, Homo sapiens
gtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagtgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtaagctgatgcctccagcttcctcagtagggctgatggcaattacgttgtgcagctactggaaagaaatgaataaacccttgtccttgtaatggtggtgaaggggagggaggtagtttgaatacaacttcacttaattttacttccctattcaggcaggaattgccaaaccatccaggagtggaatatgcaacctggcgtcatgggccagctggttaaaataaaattgatttctggctta

SEQ ID NO: 2895 - DNA, 10494 bp, Homo sapiens
agagcacaggctttgaccgatagtaacctctgcgctcggtgcagccgaatctataaaaggaactagtcccggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccaaaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaa

SEQ ID NO: 2896 - DNA, 1540 bp, Homo sapiens
gtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgatggatgtgacatgtgatgacattgcacatgggcagttaactgtgccaagaagtgcagcagtagcagcaaccggagatgcaaagcccaacatgatggggagagaaactcttctttcaatatgtgcttctgtaccaaaagtggaatttcacgagagacatattttgaaacatttctccttttgtgtgtgcgtgagtgtttccctgtttccagccaagggtattgtgagtttctcctgggcctccttcagaatctgggtgctctggaaagcagtgttttggcaacatggggaaagtatggcagtgtgggagggtcagctgggtctgggtttgaatattgcatttgaatattttaccagcattgatgtcggataaattatttagtccctgtaagcctcagttttctcttcttctacatacacataatatatttgactctttgttgtgattattggttacacatatgaagagcctggtgtggggcctggcacacaataggtgctcaataaatagaagttgataattt

SEQ ID NO: 2897 - DNA, 6362 bp, Homo sapiens
tagtagtactaacaacgttttataggagcacaattaattttacttaggataagtgttgttattattgtttttattgttgttctgttagttactcaaaacttcattctaattgtgccctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcagagcaataaacaaataccaatgatgcgctcagccaacaattcattacactctctgaagagtaactggacaaggagaaaaacatagggaaaaaaccaacagaatttgttggcatgttctacacacagaccatggcttttcagaagccaagctgaatcaaaacagttttaaaagaggcaaccatttgtagaggagtccttgaaggattcttcattgttttcttggacaaaaagagaccagtggatccaagtgcttcaaatacttctctcttattttcttaactctattgctctgcaatatttactttaccctgttaatgaacaggacaaaatggttaaaaaagagataagcgtgcgtcaacaaattcaggctcttctgtacaagaattttcttaaaaaatggagaataaaaagagagtttattggaatggacaataacattgtttctagggctatatttgtgcatcttttcggaacacttcagagctacccgttttcctgaacaacctcctaaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacagaacactgttgggccatgcatggtgaaattttttgttacttggcaaagtactggctaaaagggtttgtagcttttcaagctgcaattaatgctgcaattatagaagtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctggctctcctggggattgacatacatttgcttcatcttcattatgtccatttttatggctctggtcataacatcaatcccaattgtatttcatactggcttcatggtgatattcacactctatagcttatatggcctttctttgatagcattggctttcctcatgagtgttttaataaggaaacctatgctcgctggtttggctggatttctcttcactgtattttggggatgtctgggattcactgtgttatatagacaacttcctttatctttgggatgggtattaagtcttcttagcccttttgccttcactgctggaatggcccagattacacacctggataattacttaagtggtgttatttttcctgatccctctggggattcatacaaaatgatagccacttttttcattttggcatttgatactcttttctatttgatattcacattatattttgagcgagttttacctgataaagatggccatggggattctccattatttttccttaagtcctcattttggtccaaacatcaaaatactcatcatgaaatctttgagaatgaaataaatcctgagcattcctctgatgattcttttgaaccggtgtctccagaattccatggaaaagaagccataagaatcagaaatgttataaaagaatataatggaaagactggaaaagtagaagcattgcaaggcatattttttgacatatatgaaggacagatcactgcaatacttgggcataatggagctggtaaatcaacactgctaaacattcttagtggattgtctgtttctacagaaggatcagccactatttataatactcaactctctgaaataactgacatggaagaaattagaaagaatattggattttgtccacagttcaattttcaatttgacttcctcactgtgagagaaaacctcagggtatttgctaaaataaaagggattcagccaaaggaagtggaacaagaggtaaaaagaattataatggaattagacatgcaaagcattcaagacattattgctaaaaaattaagtggtgggcagaagagaaaactaacactagggattgccatcttaggagatcctcaggttttgctgctagatgaaccaactgctggattggatcccttttcaagacaccgagtgtggagcctcctgaaggagcataaagtagaccgacttatcctcttcagtacccaattcatggatgaggctgacatcttggctgataggaaagtatttctgtctaatgggaagttgaaatgtgcaggatcatctttgtttctgaagcgaaagtggggtattggatatcatttaagtttacacaggaatgaaatgtgtgacacagaaaaaatcacatcccttattaagcagcacattcctgatgccaagttaacaacagaaagtgaagaaaaacttgtatatagtttgcctttggaaaaaacgaacaaatttccagatctttacagtgaccttgataagtgttctgaccagggcataaggaattatgctgtttcagtgacatctctgaatgaagtattcttgaacctagaaggaaaatcagcaattgatgaaccagattttgacattgggaaacaagagaaaatacatgtgacaagaaatactggagatgagtctgaaatggaacaggttctttgttctcttcctgaaacaagaaaggctgtcagtagtgcagctctctggagacgacaaatctatgcagtggcaacacttcgcttcttaaagttaaggcgtgaaaggagagctcttttgtgtttgttactagtacttggaattgcttttatccccatcattctagagaagataatgtataaagtaactcgtgaaactcattgttgggagttttcacccagtatgtatttcctttctctggaacaaatcccgaagacgcctcttaccagcctgttaatcgttaataatacaggatcaaatattgaagacctcgtgcattcactgaagtgtcaggatatagttttggaaatagatgactttagaaacagaaatggctcagatgatccctcctacaatggagccatcatagtgtctggtgaccagaaggattacagattttctgttgcgtgtaataccaagaaattgaattgttttcctgttcttatgggaattgttagcaatgcccttatgggaatttttaacttcacggagcttattcaaatggagagcacttcattttctcgtgatgacatagtgctggatcttggttttatagatgggtccatatttttgttgttgatcacaaactgcgtttctccttttatcggcatgagcagcatcagcgattataaaaaaaatgttcaatcccagttatggatttcaggcctctggccttcagcatactggtgtggacaggctctggtggacattccattatacttcttgattctcttttcaatacatttaatttactacttcatatttctgggattccagctttcatgggaactcatgtttgttttggtggtatgcataattggttgtgcagtttctcttatattcctcacatatgtgctttcattcatctttcgcaagtggagaaaaaataatggcttttggtcttttggcttttttattatcttaatatgtgtatccacaattatggtatcaactcaatatgaaaaactcaacttaattttgtgcatgattttcataccttccttcactttgctggggtatgtcatgttattgatccagctcgactttatgagaaacttggacagtctggacaatagaataaatgaagtcaataaaaccattcttttaacaaccttaataccataccttcagagtgttattttcctttttgtcataaggtgtctggaaatgaagtatggaaatgaaataatgaataaagacccagttttcagaatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtgaagttttgggattactaggacacaatggagctggtaaaagtacttccattaaaatgataactgggtgcacaaagccaactgcaggagtggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttatcggttattatcaataaagctaacactgagaacattttacaaataaaaatatgaggtttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggactttt

SEQ ID NO: 2898 - DNA, 6155 bp, Homo sapiens
aattaattttacttaggataagtgttgttattattgtttttattgttgttctgttagttactcaaaacttcattctaattgtgccctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcagagcaataaacaaataccaatgatgcgctcagccaacaattcattacactctctgaagagtaactggacaaggagaaaaacatagggaaaaaaccaacagaatttgttggcatgttctacacacagaccatggcttttcagaagccaagctgaatcaaaacagttttaaaagaggcaaccatttgtagaggagtccttgaaggattcttcattgttttcttggacaaaaagagaccagtggatccaagtgcttcaaatacttctctcttattttcttaactctattgctctgcaatatttactttaccctgttaatgaacaggacaaaatggttaaaaaagagataagcgtgcgtcaacaaattcaggctcttctgtacaagaattttcttaaaaaatggagaataaaaagagagtttattggaatggacaataacattgtttctagggctatatttgtgcatcttttcggaacacttcagagctacccgttttcctgaacaacctcctaaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacagaacactgttgggccatgcatggtgaaattttttgttacttggcaaagtactggctaaaagggtttgtagcttttcaagctgcaattaatgctgcaattatagaagtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctggctctcctggggattgacatacatttgcttcatcttcattatgtccatttttatggctctggtcataacatcaatcccaattgtatttcatactggcttcatggtgatattcacactctatagcttatatggcctttctttgatagcattggctttcctcatgagtgttttaataaggaaacctatgctcgctggtttggctggatttctcttcactgtattttggggatgtctgggattcactgtgttatatagacaacttcctttatctttgggatgggtattaagtcttcttagcccttttgccttcactgctggaatggcccagattacacacctggataattacttaagtggtgttatttttcctgatccctctggggattcatacaaaatgatagccacttttttcattttggcatttgatactcttttctatttgatattcacattatattttgagcgagttttacctgataaagatggccatggggattctccattatttttccttaagtcctcattttggtccaaacatcaaaatactcatcatgaaatctttgagaatgaaataaatcctgagcattcctctgatgattcttttgaaccggtgtctccagaattccatggaaaagaagccataagaatcagaaatgttataaaagaatataatggaaagactggaaaagtagaagcattgcaaggcatattttttgacatatatgaaggacagatcactgcaatacttgggcataatggagctggtaaatcaacactgctaaacattcttagtggattgtctgtttctacagaaggtaaaaagaattataatggaattagacatgcaaagcattcaagacattattgctaaaaaattaagtggtgggcagaagagaaaactaacactagggattgccatcttaggagatcctcaggttttgctgctagatgaaccaactgctggattggatcccttttcaagacaccgagtgtggagcctcctgaaggagcataaagtagaccgacttatcctcttcagtacccaattcatggatgaggctgacatcttggctgataggaaagtatttctgtctaatgggaagttgaaatgtgcaggatcatctttgtttctgaagcgaaagtggggtattggatatcatttaagtttacacaggaatgaaatgtgtgacacagaaaaaatcacatcccttattaagcagcacattcctgatgccaagttaacaacagaaagtgaagaaaaacttgtatatagtttgcctttggaaaaaacgaacaaatttccagatctttacagtgaccttgataagtgttctgaccagggcataaggaattatgctgtttcagtgacatctctgaatgaagtattcttgaacctagaaggaaaatcagcaattgatgaaccagattttgacattgggaaacaagagaaaatacatgtgacaagaaatactggagatgagtctgaaatggaacaggttctttgttctcttcctgaaacaagaaaggctgtcagtagtgcagctctctggagacgacaaatctatgcagtggcaacacttcgcttcttaaagttaaggcgtgaaaggagagctcttttgtgtttgttactagtacttggaattgcttttatccccatcattctagagaagataatgtataaagtaactcgtgaaactcattgttgggagttttcacccagtatgtatttcctttctctggaacaaatcccgaagacgcctcttaccagcctgttaatcgttaataatacaggatcaaatattgaagacctcgtgcattcactgaagtgtcaggatatagttttggaaatagatgactttagaaacagaaatggctcagatgatccctcctacaatggagccatcatagtgtctggtgaccagaaggattacagattttctgttgcgtgtaataccaagaaattgaattgttttcctgttcttatgggaattgttagcaatgcccttatgggaatttttaacttcacggagcttattcaaatggagagcacttcattttctcgtgatgacatagtgctggatcttggttttatagatgggtccatatttttgttgttgatcacaaactgcgtttctccttttatcggcatgagcagcatcagcgattataaaaaaaatgttcaatcccagttatggatttcaggcctctggccttcagcatactggtgtggacaggctctggtggacattccattatacttcttgattctcttttcaatacatttaatttactacttcatatttctgggattccagctttcatgggaactcatgtttgttttggtggtatgcataattggttgtgcagtttctcttatattcctcacatatgtgctttcattcatctttcgcaagtggagaaaaaataatggcttttggtcttttggcttttttattatcttaatatgtgtatccacaattatggtatcaactcaatatgaaaaactcaacttaattttgtgcatgattttcataccttccttcactttgctggggtatgtcatgttattgatccagctcgactttatgagaaacttggacagtctggacaatagaataaatgaagtcaataaaaccattcttttaacaaccttaataccataccttcagagtgttattttcctttttgtcataaggtgtctggaaatgaagtatggaaatgaaataatgaataaagacccagttttcagaatctctccacggagtagagaaactcatcccaatccggaagagcccgaagaagaagatgaagatgttcaagctgaaagagtccaagcagcaaatgcactcactgctccaaacttggaggaggaaccagtcataactgcaagctgtttacacaaggaatattatgagacaaagaaaagttgcttttcaacaagaaagaagaaaatagccatcagaaatgtttccttttgtgttaaaaaaggtgaagttttgggattactaggacacaatggagctggtaaaagtacttccattaaaatgataactgggtgcacaaagccaactgcaggagtggtggtgttacaaggcagcagagcatcagtaaggcaacagcatgacaacagcctcaagttcttggggtactgccctcaggagaactcactgtggcccaagcttacaatgaaagagcacttggagttgtatgcagctgtgaaaggactgggcaaagaagatgctgctctcagtatttcacgattggtggaagctcttaagctccaggaacaacttaaggctcctgtgaaaactctatcagagggaataaagagaaagctgtgctttgtgctgagcatcctggggaacccatcagtggtgcttctagatgagccgttcaccgggatggaccccgaggggcagcagcaaatgtggcagatacttcaggctaccgttaaaaacaaggagaggggcaccctcttgaccacccattacatgtcagaggctgaggctgtgtgtgaccgtatggccatgatggtgtcaggaacgctaaggtgtattggttccattcaacatctgaaaaacaagtttggtagagattatttactagaaataaaaatgaaagaacctacccaggtggaagctctccacacagagattttgaagcttttcccacaggctgcttggcaggaaagatattcctctttaatggcgtataagttacctgtggaggatgtccaccctctatctcgggcctttttcaagttagaggcgatgaaacagaccttcaacctggaggaatacagcctctctcaggctaccttggagcaggtattcttagaactctgtaaagagcaggagctgggaaatgttgatgataaaattgatacaacagttgaatggaaacttctcccacaggaagacccttaaaatgaagaacctcctaacattcaattttaggtcctactacattgttagtttccataattctacaagaatgtttccttttacttcagttaacaaaagaaaacatttaataaacattcaataatgattacagttttcatttttaaaaatttaggatgaaggaaacaaggaaatatagggaaaagtagtagacaaaattaacaaaatcagacatgttattcatccccaacatgggtctattttgtgcttaaaaataatttaaaaatcatacaatattaggttggttatcggttattatcaataaagctaacactgagaacattttacaaataaaaatatgaggtttttagcctgaacttcaaatgtatcagctatttttaaacattatttactcggattctaatttaatgtgacattgactataagaaggtctgataaactgatgaaatggcacagcataacatttaattataatgacattctgattataaaataaatgcatgtgaattttagtacatattgaagttatatggaagaagatagccataatctgtaagaaagtaccgcagttaatattttctttagccaacttatattcaatgtattttttatggatcctttttcaaaggtagtatcagtaggcatagtcattttctgtatcttttcacctcacagttcatgaacatttcccatgtcattatagcacttttgtgttatataattgctgcattaatgttatagctgtattgatgtaataccagagttgttacgttcgggttatatgcaagtttatttcttagaaataaaactttgatggactttt

SEQ ID NO: 2899 - DNA, 688 bp, Homo sapiens
gtagaggagtccttgaaggattcttcattgttttcttggacaaaaagagaccagtggatccaagtgcttcaaatacttctctcttattttcttaactctattgctctgcaatatttactttaccctgttaatgaacaggacaaaatggttaaaaaagagataagcgtgcgtcaacaaattcaggctcttctgtacaagaattttcttaaaaaatggagaataaaaagagagtttattggaatggacaataacattgtttctagggctatatttgtgcatcttttcggaacacttcagagctacccgttttcctgaacaacctcctaaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacaggtcacaacaaatcattctgtaatggaggagttgacatcagttattggaataaatatgaagataccacctttcatttctaa

SEQ ID NO: 2900 - DNA, 2238 bp, Homo sapiens
aattaattttacttaggataagtgttgttattattgtttttattgttgttctgttagttactcaaaacttcattctaattgtgccctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcagagcaataaacaaataccaatgatgcgctcagccaacaattcattacactctctgaagagtaactggacaaggagaaaaacatagggaaaaaaccaacagaatttgttggcatgttctacacacagaccatggcttttcagaagccaagctgaatcaaaacagttttaaaagaggcaaccatttgtagaggagtccttgaaggattcttcattgttttcttggacaaaaagagaccagtggatccaagtgcttcaaatacttctctcttattttcttaactctattgctctgcaatatttactttaccctgttaatgaacaggacaaaatggttaaaaaagagataagcgtgcgtcaacaaattcaggctcttctgtacaagaattttcttaaaaaatggagaataaaaagagagtttattggaatggacaataacattgtttctagggctatatttgtgcatcttttcggaacacttcagagctacccgttttcctgaacaacctcctaaagtcctgggaagcgtggatcagtttaatgactctggcctggtagtggcatatacaccagtcagtaacataacacaaaggataatgaataagatggccttggcttcctttatgaaaggaagaacagtcattgggacaccagatgaagagaccatggatatagaacttccaaaaaaataccatgaaatggtgggagttatatttagtgatactttctcatatcgcctgaagtttaattggggatatagaatcccagttataaaggagcactctgaatacacagaacactgttgggccatgcatggtgaaattttttgttacttggcaaagtactggctaaaagggtttgtagcttttcaagctgcaattaatgctgcaattatagaagtcacaacaaatcattctgtaatggaggagttgacatcagttattggaataaatatgaagataccacctttcatttctaagggagaaattatgaatgaatggtttcattttacttgcttagtttctttctcttcttttatatactttgcatcattaaatgttgcaagggaaagaggaaaatttaagaaactgatgacagtgatgggtctccgagagtcagcattctggctctcctggggattgacatacatttgcttcatcttcattatgtccatttttatggctctggtcataacatcaatcccaattgtatttcatactggcttcatggtgatattcacactctatagcttatatggcctttctttgatagcattggctttcctcatgagtgttttaataaggaaacctatgctcgctggtttggctggatttctcttcactgtattttggggatgtctgggattcactgtgttatatagacaacttcctttatctttgggatgggtattaagtcttcttagcccttttgccttcactgctggaatggcccagattacacacctggataattacttaagtggtgttatttttcctgatccctctggggattcatacaaaatgatagccacttttttcattttggcatttgatactcttttctatttgatattcacattatattttgagcgagttttacctgataaagatggccatggggattctccattatttttccttaagtcctcattttggtccaaacatcaaaatactcatcatgaaatctttgagaatgaaataaatcctgagcattcctctgatgattcttttgaaccggtgtctccagaattccatggaaaagaagccataagaatcagaaatgttataaaagaatataatggaaagactggaaaagtagaagcattgcaaggaagtgaggagcgtctctgccccgccgcccatcgtctgagatgtggggagcgcctctgccccgccgcccatcatctgggatgtgaggagcgcccctgcccggccgcgaccccgtctgggaactga

SEQ ID NO: 2901 - DNA, 9100 bp, Homo sapiens
gaagagttgattgagaagtgcctcttggttaaggattaaccacagggaaaaatccagcagaaacagaagaactgtgggtttcttaccccagccctcaaggaagctatgccgtgaaaggggtactgatacactgacatacagcaagttggacggggcatcagttcttcatttgtggagtggagaaaagaagaggaaatctctcatttggggcatttgaaggatggcttccctgtttcatcagcttcagatcctggtctggaaaaattggctaggtgtaaaaaggcagccgctttggacacttgtcttgatcttatggccagtcattattttcataattttggctattactcggaccaaatttcctccaactgcaaaaccaacttgttacctcgcacctcgaaaccttcctagtactggattctttccattcctgcagaccctactctgtgacacagactctaaatgcaaagacacaccctatggcccacaagatctgcttcgtaggaaaggaattgatgatgcactatttaaagacagtgagattctgagaaagtcatccaacctggataaggacagcagtttatcattccagagcacccaagttccagaaagaaggcatgcatcactagccacagtatttcccagtccaagttctgatttggaaatccccggaacatatactttcaatggcagtcaagtgctcgcacgaattcttggcttggaaaagctgttaaagcaaaattcaacttcagaagatatacgaagagaactatgtgacagctattcaggatacattgtggatgatgccttctcttggacctttctaggaagaaatgtttttaacaaattttgcctttctaacatgacccttttagagtcttctctccaagaactaaacaaacagttctcccagctatccagtgaccccaacaatcagaagatagtgtttcaggaaatagtcagaatgctgtctttcttctcacaagtgcaagagcagaaagctgtgtggcagcttctgtctagttttccaaatgtgtttcagaatgacacatcactaagcaatctatttgatgttcttcgaaaggcaaacagtgtgctgctggttgtgcagaaggtttatccacgttttgcaactaacgaaggtttcagaaccctccagaagtctgttaaacatctgctgtacactctggactccccagctcaaggtgactccgataatataacgcatgtgtggaatgaggatgatggacagaccttatctccaagcagtctggctgcacagctcctaattctggaaaactttgaagatgccctcttaaatatatcagcaaatagtccttatattccttacttggcatgtgtgagaaatgtgactgacagtttggccagaggttcaccagaaaatctaagactcctgcagtccacaatacgatttaaaaaatcttttcttcgcaatggttcctatgaagattactttcctccagttcctgaagtcctaaaatcaaaactgtctcaacttcgaaacttgaccgaacttctttgtgaatctgaaactttcagtttgatagagaagtcatgccagctctctgatatgagctttgggagcctgtgtgaagaaagtgagtttgatctgcaactcctcgaagcggcagagctgggcaccgaaatagcagccagcttactgtaccatgacaatgtcatatctaaaaaagtgagagatttgctgactggagatccaagcaaaattaatttaaatatggatcagtttctagaacaggcactgcaaatgaattacttggaaaatatcactcagttaataccgatcatagaagccatgctgcatgtcaataacagtgcagatgcttctgaaaagccaggtcagttactagaaatgtttaaaaatgttgaagagctgaaagaagatttaaggagaacaacaggaatgtccaacaggactattgacaagttgctggccattcccatccctgataatagagctgagattatttctcaggtgttctggctgcattcctgtgatactaatatcaccactcccaaactagaagatgcaatgaaagaattctgcaacctgtctctttcagagagatcccggcagtcttacctcatcggactcacccttctgcactacttaaacatttacaacttcacatacaaggtgtttttcccgaggaaagatcaaaagccagtagaaaagatgatggagctcttcataagactaaaagagattctcaatcagatggcttctggcacacatccgctgctagacaaaatgagatccctgaagcaaatgcatctgcccagaagtgttccattaacacaggcaatgtacagaagcaaccgaatgaacacaccacaaggatcatttagcaccatctcccaagcattatgttctcaaggaattaccactgaatatttaactgccatgctgccctcttcccagaggccaaaaggcaaccacaccaaggattttttgacttataaattaactaaagagcaaattgcttcaaaatatggaattcccataaattccacaccattttgcttctccctttataaagacatcattaacatgcccgctggacctgtgatttgggctttcttgaaacctatgttgttgggaagaattttgtatgcaccatataacccagtcacaaaggcaataatggaaaagtccaatgtaactctgagacagctggcggaattaagagaaaaatctcaagagtggatggataagtcgccacttttcatgaattccttccatctgttaaaccaggcaattccaatgctccagaatactctaaggaacccttttgtgcaagtttttgtaaagttctccgtgggactcgatgctgttgaactattgaaacagatagatgaactcgatattctaagactgaaattagagaacaacattgacatcatcgatcagcttaacacactatcttccctgacagtaaatatttcctcttgtgtattatatgaccgtattcaggcagcaaaaaccatagatgaaatggagagagaggctaaaaggctctacaaaagcaacgaactctttggaagtgttatttttaagcttccttctaacagaagctggcacagaggctatgactctggaaatgtctttcttcctcctgtcataaaatataccatccggatgagtctcaagaccgcacagaccacaagaagcctaagaaccaagatttgggctccagggccacacaattctccatcacacaaccagatctatggcagggcttttatttatttacaggatagtattgaaagagcaatcattgaattgcaaactggaaggaactcccaggaaatagcagtccaggttcaagcaattccttatccctgcttcatgaaagacaacttcctaaccagtgtctcttattctcttccaattgtgcttatggttgcctgggttgtatttatagctgcctttgtaaaaaagcttgtctatgagaaagacctccggcttcatgagtacatgaagatgatgggtgtgaactcctgcagccatttctttgcctggcttatagagagtgttggatttttactggttaccatcgtgatcctcatcattatactcaagtttggcaatattcttcctaaaacaaatgggttcattttgttcctgtatttttcggactacagcttctcggttattgccatgagctatcttatcagtgtcttcttcaacaacaccaacattgcagctctgatcggaagcctcatctacatcattgccttctttccatttattgttctggttacagtggagaatgagttgagctatgtattgaaagtgttcatgagcctgctgtccccaacagcattcagctatgcaagccaatacattgcacgatacgaagaacagggcattggtcttcagtgggaaaatatgtacacctccccggttcaggatgacaccacctcatttggctggctgtgctgtctaatcctagctgactctttcatttatttccttattgcttggtatgtcaggaatgtcttcccagggacatacggtatggcagctccctggtattttccaattcttccttcctattggaaggagcgatttgggtgtgcagaggtgaagcctgagaagagcaatggcctcatgtttactaacatcatgatgcagaacaccaacccatctgccagtcctgaatacatgttttcctctaacatcgagcctgaacctaaagatctcacagtcggggttgccctgcatggggtcacaaagatctatggctcaaaagttgctgttgataacctcaatctgaacttttatgaagggcatattacttcattgctggggcccaatggagctgggaaaactactaccatttccatgttaactgggctgtttggggcctcagcaggcaccatttttgtatatggaaaagatatcaaaacagacctacacacggtacggaagaacatgggagtctgtatgcagcacgacgtcttgttcagttacctcactactaaggagcaccttctcctatatggttccatcaaagttcctcactggactaaaaagcagctccacgaggaagtaaaaaggactttaaaagatactggactatatagccatcgtcataagagagttggaacactgtcaggaggcatgaagaggaagttatctatatccatagctctcattggtggatcaagggtagtaattttggatgaaccatctactggagttgacccatgttctcgccgaagtatatgggatgttatatccaagaacaaaactgccagaacaatcattctgtcaacgcaccacttggacgaggctgaagtgctgagtgaccgcatcgccttcctggagcagggtgggcttaggtgctgtgggtccccattttacctcaaggaagcctttggcgatgggtatcacctcacgcttaccaagaagaagagtccaaatttaaatgcaaatgcagtatgtgacaccatggccgtgacagcaatgatccaatcacatctccccgaagcctacctcaaggaggatattgggggagagcttgtttatgtacttcctccattcagcaccaaagtctcaggggcctacctgtcactcctacgggcactcgacaatggcatgggtgacctcaacatcgggtgctacggcatttcagataccaccgtggaggaggtctttctgaacttgaccaaagagtcacaaaaaaatagtgctatgagtcttgagcacttaacacaaaagaaaattgggaattccaatgccaatggcatctcaactcctgacgatttatctgtgagcagcagcaatttcacagacagagatgacaaaatcctgacaagaggagagaggctggatggctttggactgttgctgaagaagatcatggctatactcatcaagaggttccaccacacccgcaggaactggaaaggtctcattgctcaggttatcctccccatcgtctttgttaccactgccatgggccttggcacactgagaaattccagcaacagttatccagagattcagatctccccctctctttatggtacctccgaacagacagccttctatgctaattatcacccgagcacggaagcacttgtctcagcaatgtgggacttccctggaattgacaacatgtgtctgaacaccagtgatctacagtgtttaaacaaagacagtctggaaaaatggaacaccagtggagaacccatcactaattttggtgtttgctcctgctcagaaaatgtccaggaatgtcctaaatttaactattccccaccgcacagaagaacttactcatcccaggtaatttataacctcactgggcaacgagtggaaaattatcttatatcaactgcaaatgagtttgtccaaaaaagatatggaggttggagttttgggctgcctttgacaaaagaccttcgttttgatataacaggagtccctgccaatagaacacttgccaaggtatggtatgatccagaaggctatcactcccttccagcttacctcaacagcctgaataatttccttctgcgagttaacatgtcaaaatacgatgctgcccgacatggcatcatcatgtatagccatccttatccaggagtgcaagaccaagaacaagccacaatcagcagtttaatcgatattttagtggcactgtctatcttgatgggctactctgtcaccaccgccagctttgtcacctatgttgtaagggaacatcaaaccaaagccaaacagttgcagcacatttcaggcattggcgtgacatgctactgggtaacaaacttcatttatgacatggttttctacttggtgcctgtagcgttttcaattggtatcattgcgattttcaaattacctgcattctacagtgaaaacaacctaggcgctgtatctctcctacttctcctgtttgggtatgcaacattttcctggatgtacttgctggctgggctcttccatgaaacaggaatggccttcatcacttacgtctgtgtcaacttgttttttggcattaattccattgtttccctgtcagtggtatactttctttccaaggaaaagcctaatgatccgactttagaacttatttctgaaaccctcaagcgcattttcctgattttcccacaattctgttttggctacggtttgattgaactttctcaacaacagtcggtcctagacttcttaaaagcatatggagtggaatacccaaatgaaacctttgagatgaataaactaggtgcaatgtttgtggctttggtttctcagggcaccatgtttttttccttgcgactcttaatcaacgaatccctgataaagaaactcaggcttttcttcagaaaatttaattcttcacatgtaagggagacaatagatgaggatgaagatgtgcgggctgagagattaagagttgagagtggtgcagctgaatttgacttggtccaactttattgtctcacaaagacctaccaacttatccacaaaaagattatagctgtaaacaacatcagcattgggatacctgctggagagtgttttgggcttcttggagtgaatggagcaggaaagaccactatattcaagatgctgacaggagacatcattccttcaagtggaaacattctgatcagaaataagaccggatctctgggtcacgttgattctcacagctcattagttggctactgtcctcaggaagatgccttagatgacctggtaactgtggaagaacatttgtatttctatgccagggtacatggaattccagaaaaggatattaaagaaactgttcataaactccttaggagacttcacctgatgcccttcaaggacagagctacctctatgtgcagttatggcacaaaaagaaaattatccactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaacacttccagcaaactcaatctcagcgtgtgaccaatggcttcattttgaagaaaagccacagaagatacacttccgcaagatatcttcattttaaagtaaagtaatatactgtatggaaagttacaactgtgttagactaacaagtaattataaaaggaaatttttccttctaaggtcagtgagtgttgttgctactgaaatgaattcctgtatactcaacactgtgagcatgctaatgtatatgctggtgattcttatgcaaaggtgaagccacctcaagatgaatatcttaatttattactttcaataaaaagacagtttaaaaggcatggattttggtagttgaaatataagagtggagaagaaaagtcagatggtttgtggcaggtgccaccgggcaagcagacaacataatttatttccagaaaacaacagaatgaacatcatcatgaatacatgaatcggctgtgatgtgtgaactgctaagggccaaatgaacgtttgcagagcagtgggcacaatgtttacaatgtatgtgtatgtcactttcggtacctgtgaatgcatggggacgtgctgaacccgaaaaaaagtgcctttccataaggactgcaatagagagggcaatttaccctggtggtacacggaacctagattcactcctgccatgccttgccaatagtaagctgcagggtggaacaagaaatcacttgctctggggggaagggaggggggaatgggtgtgtcagctgggtagatacaaaccctgaaaagagaatccatgtgctactggcaggcaacattttttaaagctctttcagaaaccctcatatttggggtttcttttcaggaaacattcctgtggagggaaaacgaatatgaagataattttcagctaattatctgggtgacccagaatcgtgtatatggctataggatagacttcttaataatggcaagtgacgtggccctggggaaaggtgctttatgtaccgtgtgtgcgtgtatgtgtgtgtatctatacaagtttgtcagctttggcatgactgtttgtctcgaaaaccaataaactcaaagtttagaaaaactca

SEQ ID NO: 2902 - DNA, 7005 bp, Homo sapiens
atttcctataaatatcacaaatatttccaacaaaagagcatagatgtcttttatacaattcttttgagaatgattctgcagatttctgcattttctcctcattaatttgacctgggatggttttcactgaggaaaaaaatctttaagcaaacatgttaaatgtttacctatataaaaattattacttcaggtgactccgataatataacgcatgtgtggaatgaggatgatggacagaccttatctccaagcagtctggctgcacagctcctaattctggaaaactttgaagatgccctcttaaatatatcagcaaatagtccttatattccttacttggcatgtgtgagaaatgtgactgacagtttggccagaggttcaccagaaaatctaagactcctgcagtccacaatacgatttaaaaaatcttttcttcgcaatggttcctatgaagattactttcctccagttcctgaagtcctaaaatcaaaactgtctcaacttcgaaacttgaccgaacttctttgtgaatctgaaactttcagtttgatagagaagtcatgccagctctctgatatgagctttgggagcctgtgtgaagaaagtgagtttgatctgcaactcctcgaagcggcagagctgggcaccgaaatagcagccagcttactgtaccatgacaatgtcatatctaaaaaagtgagagatttgctgactggagatccaagcaaaattaatttaaatatggatcagtttctagaacaggcactgcaaatgaattacttggaaaatatcactcagttaataccgatcatagaagccatgctgcatgtcaataacagtgcagatgcttctgaaaagccaggtcagttactagaaatgtttaaaaatgttgaagagctgaaagaagatttaaggagaacaacaggaatgtccaacaggactattgacaagttgctggccattcccatccctgataatagagctgagattatttctcaggtgttctggctgcattcctgtgatactaatatcaccactcccaaactagaagatgcaatgaaagaattctgcaacctgtctctttcagagagatcccggcagtcttacctcatcggactcacccttctgcactacttaaacatttacaacttcacatacaaggtgtttttcccgaggaaagatcaaaagccagtagaaaagatgatggagctcttcataagactaaaagagattctcaatcagatggcttctggcacacatccgctgctagacaaaatgagatccctgaagcaaatgcatctgcccagaagtgttccattaacacaggcaatgtacagaagcaaccgaatgaacacaccacaaggatcatttagcaccatctcccaagcattatgttctcaaggaattaccactgaatatttaactgccatgctgccctcttcccagaggccaaaaggcaaccacaccaaggattttttgacttataaattaactaaagagcaaattgcttcaaaatatggaattcccataaattccacaccattttgcttctccctttataaagacatcattaacatgcccgctggacctgtgatttgggctttcttgaaacctatgttgttgggaagaattttgtatgcaccatataacccagtcacaaaggcaataatggaaaagtccaatgtaactctgagacagctggcggaattaagagaaaaatctcaagagtggatggataagtcgccacttttcatgaattccttccatctgttaaaccaggcaattccaatgctccagaatactctaaggaacccttttgtgcaagtttttgtaaagttctccgtgggactcgatgctgttgaactattgaaacagatagatgaactcgatattctaagactgaaattagagaacaacattgacatcatcgatcagcttaacacactatcttccctgacagtaaatatttcctcttgtgtattatatgaccgtattcaggcagcaaaaaccatagatgaaatggagagagaggctaaaaggctctacaaaagcaacgaactctttggaagtgttatttttaagcttccttctaacagaagctggcacagaggctatgactctggaaatgtctttcttcctcctgtcataaaatataccatccggatgagtctcaagaccgcacagaccacaagaagcctaagaaccaagatttgggctccagggccacacaattctccatcacacaaccagatctatggcagggcttttatttatttacaggatagtattgaaagagcaatcattgaattgcaaactggaaggaactcccaggaaatagcagtccaggttcaagcaattccttatccctgcttcatgaaagacaacttcctaaccagtgtctcttattctcttccaattgtgcttatggttgcctgggttgtatttatagctgcctttgtaaaaaagcttgtctatgagaaagacctccggcttcatgagtacatgaagatgatgggtgtgaactcctgcagccatttctttgcctggcttatagagagtgttggatttttactggttaccatcgtgatcctcatcattatactcaagtttggcaatattcttcctaaaacaaatgggttcattttgttcctgtatttttcggactacagcttctcggttattgccatgagctatcttatcagtgtcttcttcaacaacaccaacattgcagctctgatcggaagcctcatctacatcattgccttctttccatttattgttctggttacagtggagaatgagttgagctatgtattgaaagtgttcatgagcctgctgtccccaacagcattcagctatgcaagccaatacattgcacgatacgaagaacagggcattggtcttcagtgggaaaatatgtacacctccccggttcaggatgacaccacctcatttggctggctgtgctgtctaatcctagctgactctttcatttatttccttattgcttggtatgtcaggaatgtcttcccagggacatacggtatggcagctccctggtattttccaattcttccttcctattggaaggagcgatttgggtgtgcagaggtgaagcctgagaagagcaatggcctcatgtttactaacatcatgatgcagaacaccaacccatctgccagtcctgaatacatgttttcctctaacatcgagcctgaacctaaagatctcacagtcggggttgccctgcatggggtcacaaagatctatggctcaaaagttgctgttgataacctcaatctgaacttttatgaagggcatattacttcattgctggggcccaatggagctgggaaaactactaccatttccatgttaactgggctgtttggggcctcagcaggcaccatttttgtatatggaaaagatatcaaaacagacctacacacggtacggaagaacatgggagtctgtatgcagcacgacgtcttgttcagttacctcactactaaggagcaccttctcctatatggttccatcaaagttcctcactggactaaaaagcagctccacgaggaagtaaaaaggactttaaaagatactggactatatagccatcgtcataagagagttggaacactgtcaggaggcatgaagaggaagttatctatatccatagctctcattggtggatcaagggtagtaattttggatgaaccatctactggagttgacccatgttctcgccgaagtatatgggatgttatatccaagaacaaaactgccagaacaatcattctgtcaacgcaccacttggacgaggctgaagtgctgagtgaccgcatcgccttcctggagcagggtgggcttaggtgctgtgggtccccattttacctcaaggaagcctttggcgatgggtatcacctcacgcttaccaagaagaagagtccaaatttaaatgcaaatgcagtatgtgacaccatggccgtgacagcaatgatccaatcacatctccccgaagcctacctcaaggaggatattgggggagagcttgtttatgtacttcctccattcagcaccaaagtctcaggggcctacctgtcactcctacgggcactcgacaatggcatgggtgacctcaacatcgggtgctacggcatttcagataccaccgtggaggaggtctttctgaacttgaccaaagagtcacaaaaaaatagtgctatgagtcttgagcacttaacacaaaagaaaattgggaattccaatgccaatggcatctcaactcctgacgatttatctgtgagcagcagcaatttcacagacagagatgacaaaatcctgacaagaggagagaggctggatggctttggactgttgctgaagaagatcatggctatactcatcaagaggttccaccacacccgcaggaactggaaaggtctcattgctcaggttatcctccccatcgtctttgttaccactgccatgggccttggcacactgagaaattccagcaacagttatccagagattcagatctccccctctctttatggtacctccgaacagacagccttctatgctaattatcacccgagcacggaagcacttgtctcagcaatgtgggacttccctggaattgacaacatgtgtctgaacaccagtgatctacagtgtttaaacaaagacagtctggaaaaatggaacaccagtggagaacccatcactaattttggtgtttgctcctgctcagaaaatgtccaggaatgtcctaaatttaactattccccaccgcacagaagaacttactcatcccaggtaatttataacctcactgggcaacgagtggaaaattatcttatatcaactgcaaatgagtttgtccaaaaaagatatggaggttggagttttgggctgcctttgacaaaagaccttcgttttgatataacaggagtccctgccaatagaacacttgccaaggtatggtatgatccagaaggctatcactcccttccagcttacctcaacagcctgaataatttccttctgcgagttaacatgtcaaaatacgatgctgcccgacatggcatcatcatgtatagccatccttatccaggagtgcaagaccaagaacaagccacaatcagcagtttaatcgatattttagtggcactgtctatcttgatgggctactctgtcaccaccgccagctttgtcacctatgttgtaagggaacatcaaaccaaagccaaacagttgcagcacatttcaggcattggcgtgacatgctactgggtaacaaacttcatttatgacatggttttctacttggtgcctgtagcgttttcaattggtatcattgcgattttcaaattacctgcattctacagtgaaaacaacctaggcgctgtatctctcctacttctcctgtttgggtatgcaacattttcctggatgtacttgctggctgggctcttccatgaaacaggaatggccttcatcacttacgtctgtgtcaacttgttttttggcattaattccattgtttccctgtcagtggtatactttctttccaaggaaaagcctaatgatccgactttagaacttatttctgaaaccctcaagcgcattttcctgattttcccacaattctgttttggctacggtttgattgaactttctcaacaacagtcggtcctagacttcttaaaagcatatggagtggaatacccaaatgaaacctttgagatgaataaactaggtgcaatgtttgtggctttggtttctcagggcaccatgtttttttccttgcgactcttaatcaacgaatccctgataaagaaactcaggcttttcttcagaaaatttaattcttcacatgtaagggagacaatagatgaggatgaagatgtgcgggctgagagattaagagttgagagtggtgcagctgaatttgacttggtccaactttattgtctcacaaagacctaccaacttatccacaaaaagattatagctgtaaacaacatcagcattgggatacctgctggagagtgttttgggcttcttggagtgaatggagcaggaaagaccactatattcaagatgctgacaggagacatcattccttcaagtggaaacattctgatcagaaataagaccggatctctgggtcacgttgattctcacagctcattagttggctactgtcctcaggaagatgccttagatgacctggtaactgtggaagaacatttgtatttctatgccagggtacatggaattccagaaaaggatattaaagaaactgttcataaactccttaggagacttcacctgatgcccttcaaggacagagctacctctatgtgcagttatggcacaaaaagaaaattatccactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaacacttccagcaa

SEQ ID NO: 2903 - DNA, 17184 bp, Homo sapiens
gactgagagcagggagcagcaggcatggggcatgccgggtgccagttcaaagccctgctgtggaagaattggctctgcagactcaggaacccggtccttttccttgctgaattcttctggccttgtatcctgtttgtaattctgacagttcttcgttttcaagaacctcccagatacagagacatttgttatttgcagccccgagatctacccagctgtggtgttatcccctttgttcaaagccttctttgtaacactggatcaaggtgtaggaacttcagctatgaagggtcaatggagcatcattttcgtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccagattcttcttatggttccagtttttttacaatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaattccttaatatccctagaagatttagattggcttccactcaaccaaactttttcccaggtttctgaacttgtactgaatgtgaccatttcgacactgacatttctgcagcaacatggagtagcagtcaccgagccagtttaccacctgtccatgcagaatatagtgtgggatccacagaaagtccagtatgatctcaaatcccagtttggctttgatgatcttcacacggaacagatcctgaactcttcagctgaactgaaggagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatattacagcatctgtggaaattgcaaagcttgctgcaaaacctgccccagtggccggcactgaagagatttcttcagcttgatggagctctcagaaatgcgatagctcagaatttacattttgtccaagaagtcctcatttgcctggagacatcagctaatgattttaaatggtttgaacttaaccaattgaaactggaaaaggatgtgttcttttgggagctgaaacagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgatatttcatacacttgaaaaaacacaatttttcctggaacaagcatattattggaaagccttcaaaaagtttatcaggaagacttgcgaagtggcccaatatgtaaatatgcaagagagtttccagaacagactattggcttttcctgaggaatctccttgttttgaagaaaacatggattggaaaatgatcagtgataattattttcaatttttgaataacttactcaagtctccaacagcttccatatccagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaagtgttgttgagatttgtgaagttttccagcagactgtgaagccctcagaagccatggagatgctgcagaaagtgaagatgatggtcgtacgtgtgctcaccatcgttgcagaaaacccttcctggaccaaggacattttgtgtgctactctgagttgcaagcaaaatgggataaggcatctcattttatctgctatacaaggggtcactttggcgcaggaccacttccaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgttggccaaaagcctcgaggaaacttggtcatcagggaatcccatcatgacttttctcagcaatttcacagtaactgaggatgtaaaaataaaagatttgatgaagaatatcaccaagttgactgaggagcttcgctcttccatccaaatctcgaatgagactatccatagcattctagaagcaaatatttcccactccaaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaacaccgttttgcttgaagctttatcaggaaattctacaattgccaaatggtgctttggtgtggaccttcctaaaacccatattgcatggaaaaatactatacacaccaaacactccagaaattaacaaggtcattcaaaaggctaattacaccttttatattgtggacaaactaaaaactttatcagaaacactgctggaaatgtccagccttttccagagaagtggaagtggccagatgttcaaccagctgcaggaggccctgagaaacaaatttgtaagaaactttgtagaaaaccagttgcacattgatgtagacaaacttactgaaaaactccagacatacggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctattcctgaacaacgttggtttcttttttccactgataatgatgctgacgtggatggtgtctgtggccagcatggtcagaaagttggtgtatgagcaggagatacagatagaagagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctgtgccttctttcgacaaccgcctttggacaaggggtattttttattacattcctggaaggacaagagacagggattcaatggaataatatgtaccaggctctggaacaagggggcatgacatttggctgggtttgctggatgattctttttgattcaagcctttattttttgtgtggatggtacttgagcaacttgattcctggaacatttggtttacggaaaccatggtatttcccctttactgcctcatattggaagagtgtgggtttcttggtggagaaaaggcaatactttctaagttctagtctgttcttcttcaatgagaactttgacaataaagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcaaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtgtttttgatgcttttgcaagattccaacaagaaatctcacattgccctggggactgagtcagagctgcagaaccacaggcctacaggacatctgtctggctactgtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcagcagtgggggcgacaacttggacctcacccgtgtgcttctgcggaagtttagagatcaagatttgccctgtgcagatttaaacccacgccagaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacaaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaaccc

SEQ ID NO: 2904 - DNA, 4480 bp, Homo sapiens
gtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcaggaagaattcttcatgctggcgcacagatcccttttctcacccagaattccaggattcatgtggctgcctgaagtgtccaaatagaagtgctagtgctccctacctgaccaaccacctgggccacacactgttgaatctctcaggcttcaatatggaggagtacttgctggcaccatctgaaaaaccaaggcttggaggttggtcttttggattaaaaatccccagtgaagctggaggtgcaaatggaaacatatcaaaacccccaactctggcaaaggtgtggtataatcagaagggttttcattccctaccttcctacttaaatcatctaaacaaccttattttgtggcagcacctaccccctactgtggactggagacaatacggaataacactctacagccacccatatggaggggccttgctgaacaaggacaagatcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagagtgctttggacttctaggggtgaatggagctgggaagagcacgactttcaaaatgctgaatggtgaagtttctctaacttcaggacatgctatcatcaggactcccatgggagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggttgctggagacctcatcaggcgcttacacctcgaagcccacgcggacaaacctgtggccacctacagtgggggaaccaagcggaaactctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaacccg

SEQ ID NO: 2905 - DNA, 8154 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtcgccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccacgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 2906 - DNA, 8056 bp, Homo sapiens
cgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagtctccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccacgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 2907 - DNA, 8146 bp, Homo sapiens
agaaccgcctgatcccgaactccctgtgcagagaccagactcgcccgaatatggggagaaaaacgagccgcgtgcagcaggggccgcctcggtcccctgcctgctccgctcacggcgagcgttcctggggcctcgagtttccccccttccgctggctgctcggaatcgcgggacggacccacctggccgccctgcctcccttccagtgggtcctggccttcgagatcttcatccccctggtgctgttctttatcctgctggggctgcgacagaagaagcccaccatctccgtgaaggaagtcgccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccacgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 2908 - DNA, 8151 bp, Homo sapiens
ggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccgtgggtcctggccttcgagatcttcatccccctggtgctgttctttatcctgctggggctgcgacagaagaagcccaccatctccgtgaaggaagccttctacacagcggcgcccctgacgtctgccggcatcctgcctgtcatgcaatcgctgtgcccggacggccagcgagacgagttcggcttcctgcagtacgccaactccacggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacagtgtcttccttctctctggactcggtggccagaaacccgcaggagctctggcgtttcctgacgcaaaacttgtcgctgcccaatagcacggcccaagcactcttggccgcccgtgtggacccgcccgaggtctaccacctgctctttggtccctcatctgccctggattcacagtctggcctccacaagggtcaggagccctggagccgcctagggggcaatcccctgttccggatggaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccgcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggccaacgagacttttgcttttgtgggcaacgtgactcactatgcccaggtctggctcaacatctcggcggagatccgcagcttcctggagcagggcaggctgcagcaacacctgcgctggctgcagcagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcgtggacatcttcaagggcttccacgacgaggagagcattgtcaactacaccctcaaccaggcctaccaggacaacgtcactgtttttgccagtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccaggacatgatggagcgcgccatcatcgacacttttgtggggcacgatgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 2909 - DNA, 3299 bp, Homo sapiens
ctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatccttgacctcatcaagacagggcgttcagtggtgctgacatcacacagcatggaggagtgcgaggcgctgtgcacgcggctggccatcatggaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 2910 - DNA, 6472 bp, Homo sapiens
ccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagtccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacagtcac

SEQ ID NO: 2911 - DNA, 6449 bp, Homo sapiens
gcggccgctgcgtccgccagtagcgggttgcaggcgcaccctcccctccagggcggccacgcagctgtcagtgccgccgccactgcgaggctggagcggagcccgggtggccgagggaggggaccccgcgagagggccgcgcgccggccgccgccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgttttctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaacctacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagtccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacagtc

SEQ ID NO: 2912 - DNA, 7309 bp, Homo sapiens
gccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccactctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggtggcatgcagagaaagctgtcggttgccattgcctttgtgggagatgccaaggtggtgattctggacgaacccacctctggggtggacccttactcgagacgctcaatctgggatctgctcctgaagtatcgctcaggcagaaccatcatcatgtccactcaccacatggacgaggccgacctccttggggaccgcattgccatcattgcccagggaaggctctactgctcaggcaccccactcttcctgaagaactgctttggcacaggcttgtacttaaccttggtgcgcaagatgaaaaacatccagagccaaaggaaaggcagtgaggggacctgcagctgctcgtctaagggtttctccaccacgtgtccagcccacgtcgatgacctaactccagaacaagtcctggatggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagagatttttctgaaggtcacggaggattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaa

SEQ ID NO: 2913 - DNA, 3105 bp, Homo sapiens
gcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccactctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttctccgcaggcgccccactctcctccaagggacccgagcgccatctgctgagaggagaacacggcccgccatggtttcccaaggagcagcagacacggacctcgcagggggcagcgaacccacgtgacacagtcttcaagtcctttggagagccccaggaaggaacaacagcgtgtacaccctgtgatggaatgttctctagggcggttcagtgtgaatggaatgtggggccggtgccattctaattggttctgtttccctctagtggttgatcgcggagatttcggcttctccatcaggacaagttcagatagcctgagatggtatcag

SEQ ID NO: 2914 - DNA, 1459 bp, Homo sapiens
tttaattgattagctccttggcctggccttgaggcactgcttacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcg

SEQ ID NO: 2915 - DNA, 1780 bp, Homo sapiens
aagaccaacatgagcctccatttcatgtgatgataagatataccaactgatggagaccaacacaaatgaccttctcatccatggttttttaaaatgatgatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcg

SEQ ID NO: 2916 - DNA, 3740 bp, Homo sapiens
actggaggaaaacatgttctgggccggagtggtattccctgacatgtatccctggaccagctctctaccaccccacgtgtccagcccacgtcgatgacctaactccagaacaagtcctggatggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagagatttttctgaaggtcacggaggattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaact

SEQ ID NO: 2917 - DNA, 9236 bp, Homo sapiens
agtagagacagggtttcaccatgttggtcaggctggtctcaaactcctgacttcgtgatctgcccaccttggcctcccaaagtgctgggattacaggcgtgagccaccgcacccggtcagctattttctacatgcttcatttgcagtgtaatattggattgtatgagactttgggttttgtgttaatacctacagaaaatgttgatattttctcttagcaggctgtcaaccaggttaggttcaggtcataagtttctacccacattctttgaactgtagttgtcattttagtttatttttcaaaaacttttgcagtacctttttggtctgtcttgtgtgtgccttgcagtgaacagtctggatttggacagtggtctgtctgttagttcagtttctcaagcctttgtcacactaataggattggatttatgtatgtccagcttgggaattattacaggaattaaaaacaactttttagagtgctttcctgagctctctttctatttgttcccccttctactttttgcttccctgtggctgctgtttctatcctccagccagagagctagtgtttattttctccattgtgttacacacttgtgcagctgcaaccaccatatccagggcccaatggtaggaggtagagaagaaaagcaaaagggattggcctcatcctcttacaacgatagttccattgaatagagagaaaggttttcctgcctcagagtgttggctgcactaggcttttgttactgtagtctggccctgttaccatgggattgcttgcatgtggggatacaggagaattcagaaaagaaaaaaagatttgctatttctacattctccctgagcattaagacttcccttgcccattcctcaattcaaagctaaggcttcttctggagctgcctctgtgggcggttcgggagataccaaaggagaaaaagtaccactgttgatatggtggtatttcaaattctggtctaccctatttcacatgccttgtttacttttcagagctgacagattgctgctccatgcattctgtccagtttcctaagagagacagcttggagtatgcttaatccatcttacctgggactgaaacagctgcttattttgccgttaaaaattacatgcagtttactgcgtggctccgggtttgtttgtttgtttttcctctttaataggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtatttgtttttattggtaaactttagtgaatctcttctataaaattgtaagtagatcagtgtgtagatttatttagtaacttacctcattgactttggaacatggtaggatatgaataaactctttcaagggttaaattaagaattgtaagtgcagtgcgcctatttctttttaataagaaccagaatttcatttttgatagagttaaaggcatggctaatattttcttagaaatacttccttgtacaacccatgtattggctcaaggtataaaatagtgtaaataatgctagttgacattacatttcaaccaaatgaaagtattaacttcataaaacaaatatattgagagtgtgattattgtattagacaacaacaacagcaatgacagaaggatttggtactgaattactttaaataagcaaaacctttcagtggcattattcattctttaatgtaggcaaaatttaatgaacttttagctttattgtgtaataagacatctgtgattttaggctctagcagtggatttaaaagtgttctttctcggtacaaagtacgtggctgatattttcccccattgctgggggcagttgctatacactttcctaaagtatatataatgttcacataaatacccagggacctcttttttgggatgtgcttttgtaattatgtgtaaccttgaatacttaagtttagtaaaagcaacaaaattatatctatagtttactaaggcagtcacgaaaaagcatagttttttttagaacctgaccatcctaagaaagttatgtcatctgaagatagagcatgactaatgaagaaaattacctgcttttgcacgtagatttggtaactttcactttacatttgtgaatgtgtaattggtgcaaagtaaattttttttcctgcaaagtgaaagttgagtagtcacaatcatgttatttattttgttcatttagttactttgcttttaatgtatatgaatacatgctcttgtaaacaattttaaaagacattcaaatttttttttagtttttatatactcagaatatattttggttgttaaattaaattatgttccctttttcacagtaacaaaatctgactcaggagaaatataacttaattcttaggaaaacaagggtaagtgagctggaaagcaaaggaggcaaaaagtgaaatatatttatttacagtgtacagttcatgtttatgaacatactaattttaaaatgtcttaaattactgatctcaaaacttttttctatgtcagtacagataaataaataaatatacatattaggcaaaagcaacatcaccaaccttatatttcccattcatggtcaaattttcaaaggaaagtaaaagctgagctttactgagtgagtgtttactgactaataaggcaagaaaaaacatgatgagtgtactttacatcttacttttgtgggctcttaatttttttctctagtttgttttcagtaaagacagtgggttttctttaaaataatttttttcttttaaatttgcacaaattatcttaggtcagtattttggttttaatcattaaaacatttttagagtaatgtaatttaacaaatattttaagtgattatgtttccagaaatggattctttggagagaactcggatgactatcagttttggccctgtaagatcgtggagatctgtaagatagatacttatataacttacataaaatatatataatatattacttatataacttatataactagctattattttatataactaactataatatgacaaatcctttgctagtagtactaacaacgttttataggagcacaattaattttacttaggataagtgttgttattattgtttttattgttgttctgttagttactcaaaacttcattctaattgtgccctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcaggtaaaagtttaattattttttatttataatatatgtaagcaattctcaatgctgctctttaagaaaaataaatatgattatattaataataagc

SEQ ID NO: 2918 - DNA, 8180 bp, Homo sapiens
agctctgcctgcgccaggagcgcgcgggtgcgcgcggccgcgccctcgcacagatcccagctgggtcacccgcactgagtcaacagactgagcgcgtccaggcctgacagctctgcggctcgggccctgaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgcagactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtatttgtttttattggtaaactttagtgaatctcttctataaaattgtaagtagatcagtgtgtagatttatttagtaacttacctcattgactttggaacatggtaggatatgaataaactctttcaagggttaaattaagaattgtaagtgcagtgcgcctatttctttttaataagaaccagaatttcatttttgatagagttaaaggcatggctaatattttcttagaaatacttccttgtacaacccatgtattggctcaaggtataaaatagtgtaaataatgctagttgacattacatttcaaccaaatgaaagtattaacttcataaaacaaatatattgagagtgtgattattgtattagacaacaacaacagcaatgacagaaggatttggtactgaattactttaaataagcaaaacctttcagtggcattattcattctttaatgtaggcaaaatttaatgaacttttagctttattgtgtaataagacatctgtgattttaggctctagcagtggatttaaaagtgttctttctcggtacaaagtacgtggctgatattttcccccattgctgggggcagttgctatacactttcctaaagtatatataatgttcacataaatacccagggacctcttttttgggatgtgcttttgtaattatgtgtaaccttgaatacttaagtttagtaaaagcaacaaaattatatctatagtttactaaggcagtcacgaaaaagcatagttttttttagaacctgaccatcctaagaaagttatgtcatctgaagatagagcatgactaatgaagaaaattacctgcttttgcacgtagatttggtaactttcactttacatttgtgaatgtgtaattggtgcaaagtaaattttttttcctgcaaagtgaaagttgagtagtcacaatcatgttatttattttgttcatttagttactttgcttttaatgtatatgaatacatgctcttgtaaacaattttaaaagacattcaaatttttttttagtttttatatactcagaatatattttggttgttaaattaaattatgttccctttttcacagtaacaaaatctgactcaggagaaatataacttaattcttaggaaaacaagggtaagtgagctggaaagcaaaggaggcaaaaagtgaaatatatttatttacagtgtacagttcatgtttatgaacatactaattttaaaatgtcttaaattactgatctcaaaacttttttctatgtcagtacagataaataaataaatatacatattaggcaaaagcaacatcaccaaccttatatttcccattcatggtcaaattttcaaaggaaagtaaaagctgagctttactgagtgagtgtttactgactaataaggcaagaaaaaacatgatgagtgtactttacatcttacttttgtgggctcttaatttttttctctagtttgttttcagtaaagacagtgggttttctttaaaataatttttttcttttaaatttgcacaaattatcttaggtcagtattttggttttaatcattaaaacatttttagagtaatgtaatttaacaaatattttaagtgattatgtttccagaaatggattctttggagagaactcggatgactatcagttttggccctgtaagatcgtggagatctgtaagatagatacttatataacttacataaaatatatataatatattacttatataacttatataactagctattattttatataactaactataatatgacaaatcctttgctagtagtactaacaacgttttataggagcacaattaattttacttaggataagtgttgttattattgtttttattgttgttctgttagttactcaaaacttcattctaattgtgccctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcaggtaaaagtttaattattttttatttataatatatgtaagcaattctcaatgctgctctttaagaaaaataaatatgattatattaataataagc

SEQ ID NO: 2919 - DNA, 5296 bp, Homo sapiens
ctgctggagtaggcacccatttaaagaaaaaatgaagaagcagcaataaagaagttgtaatcgttacctagacaaacagagaactggttttgacagtgtttctagagtgctttttattattttcctgacagttgtgttccaccatgattactttctccttcagcgaataggctaaatgaatatgaaacagaaaagcgtgtatcagcaaaccaaagcacttctgtgcaagaattttcttaagaaatggaggatgaaaagagagagcttattggaatggggcctctcaatacttctaggactgtgtattgctctgttttccagttccatgagaaatgtccagtttcctggaatggctcctcagaatctgggaagggtagataaatttaatagctcttctttaatggttgtgtatacaccaatatctaatttaacccagcagataatgaataaaacagcacttgctcctcttttgaaaggaacaagtgtcattggggcaccaaataaaacacacatggacgaaatacttctggaaaatttaccatatgctatgggaatcatctttaatgaaactttctcttataagttaatatttttccagggatataacagtccactttggaaagaagatttctcagctcattgctgggatggatatggtgagttttcatgtacattgaccaaatactggaatagaggatttgtggctttacaaacagctattaatactgccattatagaaatcacaaccaatcaccctgtgatggaggagttgatgtcagttactgctataactatgaagacattacctttcataactaaaaatcttcttcacaatgagatgtttattttattcttcttgcttcatttctccccacttgtatattttatatcactcaatgtaacaaaagagagaaaaaagtctaagaatttgatgaaaatgatgggtctccaagattcagcattctggctctcctggggtctaatctatgctggcttcatctttattatttccatattcgttacaattatcataacattcacccaaattatagtcatgactggcttcatggtcatatttatactcttttttttatatggcttatctttggtagctttggtgttcctgatgagtgtgctgttaaagaaagctgtcctcaccaatttggttgtgtttctccttaccctcttttggggatgtctgggattcactgtattttatgaacaacttccttcatctctggagtggattttgaatatttgtagcccttttgcctttactactggaatgattcagattatcaaactggattataacttgaatggtgtaatttttcctgacccttcaggagactcatatacaatgatagcaactttttctatgttgcttttggatggtctcatctacttgctattggcattatactttgacaaaattttaccctatggagatgagcgccattattctcctttatttttcttgaattcatcatcttgtttccaacaccaaaggactaatgctaaggttattgagaaagaaatcgatgctgagcatccctctgatgattattttgaaccagtagctcctgaattccaaggaaaagaagccatcagaatcagaaatgttaagaaggaatataaaggaaaatctggaaaagtggaagcattgaaaggcttgctctttgacatatatgaaggtcaaatcacggcaatcctgggtcacagtggagctggcaaatcttcactgctaaatattcttaatggattgtctgttccaacagaaggatcagttaccatctataataaaaatctctctgaaatgcaagacttggaggaaatcagaaagataactggcgtctgtcctcaattcaatgttcaatttgacatactcaccgtgaaggaaaacctcagcctgtttgctaaaataaaagggattcatctaaaggaagtggaacaagaggtacaacgaatattattggaattggacatgcaaaacattcaagataaccttgctaaacatttaagtgaaggacagaaaagaaagctgacttttgggattaccattttaggagatcctcaaattttgcttttagatgaaccaactactggattggatcccttttccagagatcaagtgtggagcctcctgagagagcgtagagcagatcatgtgatccttttcagtacccagtccatggatgaggctgacatcctggctgatagaaaagtgatcatgtccaatgggagactgaagtgtgcaggttcttctatgtttttgaaaagaaggtggggtcttggatatcacctaagtttacataggaatgaaatatgtaacccagaacaaataacatccttcattactcatcacatccccgatgctaaattaaaaacagaaaacaaagaaaagcttgtatatactttgccactggaaaggacaaatacatttccagatcttttcagtgatctggataagtgttctgaccagggagtgacaggttatgacatttccatgtcaactctaaatgaagtctttatgaaactggaaggacagtcaactatcgaacaagatttcgaacaagtggagatgataagagactcagaaagcctcaatgaaatggagctggctcactcttccttctctgaaatgcagacagctgtgagtgacatgggcctctggagaatgcaagtctttgccatggcacggctccgtttcttaaagttaaaacgtcaaactaaagtgttattgaccctattattggtatttggaatcgcaatattccctttgattgttgaaaatataatgtatgctatgttaaatgaaaagatcgattgggaatttaaaaacgaattgtattttctctctcctggacaacttccccaggaaccccgtaccagcctgttgatcatcaataacacagaatcaaatattgaagattttataaaatcactgaagcatcaaaatatacttttggaagtagatgactttgaaaacagaaatggtactgatggcctctcatacaatggagctatcatagtttctggtaaacaaaaggattatagattttcagttgtgtgtaataccaagagattgcactgttttccaattcttatgaatattatcagcaatgggctacttcaaatgtttaatcacacacaacatattcgaattgagtcaagcccatttcctcttagccacataggactctggactgggttgccggatggttcctttttcttatttttggttctatgtagcatttctccttatatcaccatgggcagcatcagtgattacaagaaaaatgctaagtcccagctatggatttcaggcctctacacttctgcttactggtgtgggcaggcactagtggacgtcagcttcttcattttaattctccttttaatgtatttaattttctacatagaaaacatgcagtaccttcttattacaagccaaattgtgtttgctttggttatagttactcctggttatgcagcttctcttgtcttcttcatatatatgatatcatttatttttcgcaaaaggagaaaaaacagtggcctttggtcattttacttcttttttgcctccaccatcatgttttccatcactttaatcaatcattttgacctaagtatattgattaccaccatggtattggttccttcatataccttgcttggatttaaaacttttttggaagtgagagaccaggagcactacagagaatttccagaggcaaattttgaattgagtgccactgattttctagtctgcttcataccctactttcagactttgctattcgtttttgttctaagatgcatggaactaaaatgtggaaagaaaagaatgcgaaaagatcctgttttcagaatttccccccaaagtagagatgctaagccaaatccagaagaacccatagatgaagatgaagatattcaaacagaaagaataagaacagccactgctctgaccacttcaatcttagatgagaaacctgttataattgccagctgtctacacaaagaatatgcaggccagaagaaaagttgcttttcaaagaggaagaagaaaatagcagcaagaaatatctctttctgtgttcaagaaggtgaaattttgggattgctaggacccaatggtgctggaaaaagttcatctattagaatgatatctgggatcacaaagccaactgctggagaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaagattagtgagtgctttcaaactgcatgagcagctgaatgttcctgtgcagaaattaacagcaggaatcacgagaaagttgtgttttgtgctgagcctcctgggaaactcacctgtcttgctcctggatgaaccatctacgggcatagaccccacagggcagcagcaaatgtggcaggcaatccaggcagtcgttaaaaacacagagagaggtgtcctcctgaccacccataacctggctgaggcggaagccttgtgtgaccgtgtggccatcatggtgtctggaaggcttagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtattcctctttgttaacctataagctgcccgtggcagacgtttaccctctatcacagacctttcacaaattagaagcagtgaagcataactttaacctggaagaatacagcctttctcagtgcacactggagaaggtattcttagagctttctaaagaacaggaagtaggaaattttgatgaagaaattgatacaacaatgagatggaaactcctccctcattcagatgaaccttaaaacctcaaacctagtaattttttgttgatctcctataaactcatgttttatgtaataattaatagtatgtttaattttaaagatcatttaaaattaacatcaggtatattttgtaaatttagttaacaaatacataaattttaaaattattcttcctctcaaacataggggtgatagcaaacctgtgataaaggcaatacaaaatattagtaaagtcacccaaagagtcaggcactgggtattgtggaaataaaactatataaactt

SEQ ID NO: 2920 - DNA, 2176 bp, Homo sapiens
agtgcaatggggcgatctctgctcactgcaacctctgcctcccagattcaagcgattctcctgcctcagcctcccaagttgctgggattacagacatttaccaccacacctggctgattttgtatttttagtagagatggggtttcaccatgttggtcaggctggttcagactcctgacctcaagtgatcctttttaaggttgaatagtatccattgtttgtatatacatacacattttgttaatccattaatttggacttttgggttgcttccacttagccacataggactctggactgggttgccggatggttcctttttcttatttttggttctatgtagcatttctccttatatcaccatgggcagcatcagtgattacaagaaaaatgctaagtcccagctatggatttcaggcctctacacttctgcttactggtgtgggcaggcactagtggacgtcagcttcttcattttaattctccttttaatgtatttaattttctacatagaaaacatgcagtaccttcttattacaagccaaattgtgtttgctttggttatagttactcctggttatgcagcttctcttgtcttcttcatatatatgatatcatttatttttcgcaaaaggagaaaaaacagtggcctttggtcattttacttcttttttgcctccaccatcatgttttccatcactttaatcaatcattttgacctaagtatattgattaccaccatggtattggttccttcatataccttgcttggatttaaaacttttttggaagtgagagaccaggagcactacagagaatttccagaggcaaattttgaattgagtgccactgattttctagtctgcttcataccctactttcagactttgctattcgtttttgttctaagatgcatggaactaaaatgtggaaagaaaagaatgcgaaaagatcctgttttcagaatttccccccaaagtagagatgctaagccaaatccagaagaacccatagatgaagatgaagatattcaaacagaaagaataagaacagccactgctctgaccacttcaatcttagatgagaaacctgttataattgccagctgtctacacaaagaatatgcaggccagaagaaaagttgcttttcaaagaggaagaagaaaatagcagcaagaaatatctctttctgtgttcaagaaggtgaaattttgggattgctaggacccaatggtgctggaaaaagttcatctattagaatgatatctgggatcacaaagccaactgctggagaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaagattagtgagtgctttcaaactgcatgagcagctgaatgttcctgtgcagaaattaacagcaggaatcacgagaaagttgtgttttgtgctgagcctcctgggaaactcacctgtcttgctcctggatgaaccatctacgggcatagaccccacagggcagcagcaaatgtggcaggcaatccaggcagtcgttaaaaacacagagagaggtgtcctcctgaccacccataacctggctgaggcggaagccttgtgtgaccgtgtggccatcatggtgtctggaaggcttagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtattcctctttgttaacctataagctgcccgtggcagacgtttaccctctatcacagacctttcacaaattagaagcagtgaagcataactttaacctggaagaatacagcctttctcagtgcacactggagaaggtattcttagagctttctaaagaacaggaagtaggaaattttgatgaagaaattgatacaacaatgagatggaaactcctccctcattcagatgaaccttaaaacctcaaacctagtaattttttgttgatctcctataaactcatgttttatgtaat

SEQ ID NO: 2921 - DNA, 6816 bp, Homo sapiens
gggcaagctcagcgcacttggcttaaggggcggcgcgctccctgcctgctgctgggcggagggaaggcggcaagagctgcggagcccctggaagagcttccaggaaccctgcgctgtgggataaaggaatgaggttcagaaaggggcagggagttgcccgcagccgcaccgcacgtcttcagcccgaccgttgtcctgacctctctgtcccgtcccctgcccagtctcaccatggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtgaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctacggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgagggtgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctggccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtggtggtg

SEQ ID NO: 2922 - DNA, 6585 bp, Homo sapiens
atggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctgcgcacggaatccctggggttggcactgggccaagcccaggagcccttgcacagcttgttggaggccgctgaggacctggcccaggagctcctggcgctgcgcagcctggtggagcttcgggcactgctgcagagaccccgagggaccagcggccccctggagttgctgtcagaggccctctgcagtgtcaggggacctagcagcacagtgggcccctccctcaactggtacgaggctagtgacctgatggagctggtggggcaggagccagaatccgccctgccagacagcagcctgagccccgcctgctcggagctgattggagccctggacagccacccgctgtcccgcctgctctggagacgcctgaagcctctgatcctcgggaagctactctttgcaccagatacaccttttacccggaagctcatggcccaggtgaaccggaccttcgaggagctcaccctgctgagggatgtccgggaggtgtgggagatgctgggaccccggatcttcaccttcatgaacgacagttccaatgtggccatgctgcagcggctcctgcagatgcaggatgaaggaagaaggcagcccagacctggaggccgggaccacatggaggccctgcgatcctttctggaccctgggagcggtggctacagctggcaggacgcacacgctgatgtggggcacctggtgggcacgctgggccgagtgacggagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggttttgggaccctggcccagccgcggaccccctgaccgacctgcgctacgtgtggggcggcttcgtgtacctgcaagacctggtggagcgtgcagccgtccgcgtgctcagcggcgccaacccccgggccggcctctacctgcagcagatgccctatccgtgctatgtggacgacgtgttcctgcgtgtgctgagccggtcgctgccgctcttcctgacgctggcctggatctactccgtgacactgacagtgaaggccgtggtgcgggagaaggagacgcggctgcgggacaccatgcgcgccatggggctcagccgcgcggtgctctggctaggctggttcctcagctgcctcgggcccttcctgctcagcgccgcactgctggttctggtgctcaagctgggagacatcctcccctacagccacccgggcgtggtcttcctgttcttggcagccttcgcggtggccacggtgacccagagcttcctgctcagcgccttcttctcccgcgccaacctggctgcggcctgcggcggcctggcctacttctccctctacctgccctacgtgctgtgtgtggcttggcgggaccggctgcccgcgggtggccgcgtggccgcgagcctgctgtcgcccgtggccttcggcttcggctgcgagagcctggctctgctggaggagcagggcgagggcgcgcagtggcacaacgtgggcacccggcctacggcagacgtcttcagcctggcccaggtctctggccttctgctgctggacgcggcgctctacggcctcgccacctggtacctggaagctgtgtgcccaggccagtacgggatccctgaaccatggaattttccttttcggaggagctactggtgcggacctcggccccccaagagtccagccccttgccccaccccgctggacccaaaggtgctggtagaagaggcaccgcccggcctgagtcctggcgtctccgttcgcagcctggagaagcgctttcctggaagcccgcagccagccctgcgggggctcagcctggacttctaccagggccacatcaccgccttcctgggccacaacggggccggcaagaccaccaccctgtccatcttgagtggcctcttcccacccagtggtggctctgccttcatcctgggccacgacgtccgctccagcatggccgccatccggccccacctgggcgtctgtcctcagtacaacgtgctgtttgacatgctgaccgtggacgagcacgtctggttctatgggcggctgaagggtctgagtgccgctgtagtgggccccgagcaggaccgtctgctgcaggatgtggggctggtctccaagcagagtgtgcagactcgccacctctctggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtcgcacgctgatcctctccacccaccacctggatgaggcagagctgctgggagaccgtgtggccgtggtggcaggtggccgcttgtgctgctgtggctccccactcttcctgcgccgtcacctgggctccggctactacctgacgctggtgaaggcccgcctgcccctgaccaccaatgagaaggctgacactgacatggagggcagtgtggacaccaggcaggaaaagaagaatggcagccagggcagcagagtcggcactcctcagctgctggccctggtacagcactgggtgcccggggcacggctggtggaggagctgccacacgagctggtgctggtgctgccctacacgggtgcccatgacggcagcttcgccacactcttccgagagctagacacgcggctggcggagctgaggctcactggctacgggatctccgacaccagcctcgaggagatcttcctgaaggtggtggaggagtgtgctgcggacacagatatggaggatggcagctgcgggcagcacctatgcacaggcattgctggcctagacgtaaccctacggctcaagatgccgccacaggagacagcgctggagaacggggaaccagctgggtcagccccagagactgaccagggctctgggccagacgccgtgggccgggtacagggctgggcactgacccgccagcagctccaggccctgcttctcaagcgctttctgcttgcccgccgcagccgccgcggcctgttcgcccagatcgtgctgcctgccctctttgtgggcctggccctcgtgttcagcctcatcgtgcctcctttcgggcactacccggctctgcggctcagtcccaccatgtacggtgctcaggtgtccttcttcagtgaggacgccccaggggaccctggacgtgcccggctgctcgaggcgctgctgcaggaggcaggactggaggagcccccagtgcagcatagctcccacaggttctcggcaccagaagttcctgctgaagtggccaaggtcttggccagtggcaactggaccccagagtctccatccccagcctgccagtgtagccggcccggtgcccggcgcctgctgcccgactgcccggctgcagctggtggtccccctccgccccaggcagtgaccggctctggggaagtggttcagaacctgacaggccggaacctgtctgacttcctggtcaagacctacccgcgcctggtgcgccagggcctgaagactaagaagtgggtgaatgaggtcagatacggaggcttctcgctggggggccgagacccaggcctgccctcgggccaagagttgggccgctcagtggaggagttgtgggcgctgctgagtcccctgcctggcggggccctcgaccgtgtcctgaaaaacctcacagcctgggctcacagcctggatgctcaggacagtctcaagatctggttcaacaacaaaggctggcactccatggtggcctttgtcaaccgagccagcaacgcaatcctccgtgctcacctgcccccaggcccggcccgccacgcccacagcatcaccacactcaaccaccccttgaacctcaccaaggagcagctgtctgagggtgcactgatggcctcctcggtggacgtcctcgtctccatctgtgtggtctttgccatgtcctttgtcccggccagcttcactcttgtcctcattgaggagcgagtcacccgagccaagcacctgcagctcatggggggcctgtcccccaccctctactggcttggcaactttctctgggacatgtgtaactacttggtgccagcatgcatcgtggtgctcatctttctggccttccagcagagggcatatgtggcccctgccaacctgcctgctctcctgctgttgctactactgtatggctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcagaagctgcaggaggtgagccggatcttgaaacaggtcttccttatcttcccccacttctgcttgggccgggggctcattgacatggtgcggaaccaggccatggctgatgcctttgagcgcttgggagacaggcagttccagtcacccctgcgctgggaggtggtcggcaagaacctcttggccatggtgatacaggggcccctcttccttctcttcacactactgctgcagcaccgaagccaactcctgccacagcccagggtgaggtctctgccactcctgggagaggaggacgaggatgtagcccgtgaacgggagcgggtggtccaaggagccacccagggggatgtgttggtgctgaggaacttgaccaaggtataccgtgggcagaggatgccagctgttgaccgcttgtgcctggggattccccctggtgagtgttttgggctgctgggtgtgaatggagcagggaagacgtccacgtttcgcatggtgacgggggacacattggccagcaggggcgaggctgtgctggcaggccacagcgtggcccgggaacccagtgctgcgcacctcagcatgggatactgccctcaatccgatgccatctttgagctgctgacgggccgcgagcacctggagctgcttgcgcgcctgcgcggtgtcccggaggcccaggttgcccagaccgctggctcgggcctggcgcgtctgggactctcatggtacgcagaccggcctgcaggcacctacagcggagggaacaaacgcaagctggcgacggccctggcgctggttggggacccagccgtggtgtttctggacgagccgaccacaggcatggaccccagcgcgcggcgcttcctttggaacagccttttggccgtggtgcgggagggccgttcagtgatgctcacctcccatagcatggaggagtgtgaagcgctctgctcgcgcctggccatcatggtgaatgggcggttccgctgcctgggcagcccgcaacatctcaagggcagattcgcggcgggtcacacactgaccctgcgggtgcccgccgcaaggtcccagccggcagcggccttcgtggcggccgagttccctggggcggagctgcgcgaggcacatggaggccgcctgcgcttccagctgccgccgggagggcgctgcgccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctgagcctccctcccctgcggggccgcggggaggccctgggaatggcaagggcaaggtagagtgcctaggagccctggactcaggctggcagaggggctggtgccctggagaaaataaagagaaggctggagagaagccgtggtggtg

SEQ ID NO: 2923 - DNA, 576 bp, Homo sapiens
ttggcttaaggggcggcgcgctccctgcctgctgctgggcggagggaaggcggcaagagctgcggagcccctggaagtctcaccatggccttctggacacagctgatgctgctgctctggaagaatttcatgtatcgccggagacagccggtccagctcctggtcgaattgctgtggcctctcttcctcttcttcatcctggtggctgttcgccactcccacccgcccctggagcaccatgaatgccacttcccaaacaagccactgccatcggcgggcaccgtgccctggctccagggtctcatctgtaatgtgaacaacacctgctttccgcagctgacaccgggcgaggagcccgggcgcctgagcaacttcaacgactccctggtctcccggctgctagccgatgcccgcactgtgctgggaggggccagtgcccacaggacgctggctggcctagggaagctgatcgccacgctgagggctgcacgcagcacggcccagcctcaaccaaccaagcagtctccactggaaccacccatgctggatgtcgcggagctgctgacgtcactgctg

SEQ ID NO: 2924 - DNA, 5718 bp, Homo sapiens
ataacctccactctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattttgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttg

SEQ ID NO: 2925 - DNA, 1595 bp, Homo sapiens
cagaagtcaaatagttaaagcaaattctagatacatggtagagaccaggagaaaatatgaataactttcttctaaacaaggagctcagtggataaaccatacctctagattccttgcttccattttcccagaagttttggtagcaggatgatgttggcctcataatgtgagttagagaggagtccctctttttcgactgtttggaattgtttcagaaggaatgctaccagctcctcttgtaccactggtagaattcagctgtgaatctgtctggtcctgggctttttttgattgacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggtgagtcaaacgcagcacaaataaataaacggaggaactcaggaaaactgggaatcttcaatgcatctttttttttttgaaatggagtctcgctctgtcgcccaggctggagtgcagtggcgtgatctcagctcactgcaagctccgcctcacaggttcacgccattctcctgcctcggcctcccaagtagctgggactgcaggtgccgaccaccatgcctggataattttttgtattttctgtagagacggggtttcaccgtgttagccaggatggtctcgatctcctgacctcgtgatccacccacctcggcctcccaaagtgctgggattacaggcgcgagccaccacgcccggcctcttcaatgcgtctttattaaaacctgtttctccacaaccaaggggtacaaatgagagatacctacacagaataatttcagatcatgaacaaatttccacttagttaatttcagtggggagaaatgctctgcagtgatgg

SEQ ID NO: 2926 - DNA, 4949 bp, Homo sapiens
agaacttcatattaattttatcttctttctttttcattaaacaagacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgt

SEQ ID NO: 2927 - DNA, 3657 bp, Homo sapiens
ctagatacatggtagagaccaggagaaaatatgaataactttcttctaaacaaggagctcagtggataaaccatacctctagattccttgcttccattttcccagaagaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtaagtatatttcttgtggatgtatactgtatatatttgatatacaattctgagctaatcctttaaattttgccctctgtaggatgataatattatggtctataataaacacaagattacaaattcagttactgacatggtcaaaactagaaattacttcaccaaagtccctaataagaattaattccataaagcctctcttcttttgtctaaatta

SEQ ID NO: 2928 - DNA, 3264 bp, Homo sapiens
actctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatattggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggaggtaaatatatataatcttacaattcctgactctcctctatcaggaatctcccagatcacccttttaagtgctggaatcttgtttttattgagtaaaccactgcataataaattaacatttggactc

SEQ ID NO: 2929 - DNA, 6445 bp, Homo sapiens
attcacaatgaatgtgaaattaaaagcatgatgtagtagtgacccaaaaggaatgtgaattctcctccagaacatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaaatcctgtgtagtattggctatgtctcatctcttgttttcttgacatatgtgatttcattcatttttcgcaatgggagaaaaaatagtggcatttggtcatttttcttcttaattgtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaagctgtgctttgtgctgagcatcctggggaacccgtcagtggtgcttctggatgagccgtcgaccgggatggaccccgaggggcagcagcaaatgtggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcggtgaagtggaaactcctcctgcaggaagagccttaaagctccaaataccctatatctttctttaatcctgtgactcttttaaagataatattttatagccttaatatgccttatatcagaggtggtacaaaatgcatttgaaactcatgcaataattatcctcagtagtatttcttacagtgagacaacaggcgatgtcagtgagggcgatcatagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttatttttttgattaaagtataaattaagacaccctattgacttccgggtaaggggagtcaattgattacccagcagcacagtatttgctttttataattccctttttaaatacttgttcttaattcactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaataatttcagtaagaacctgatcaagttgaacatgtatatatatgttatacacaagtttgaaacatatttctgtttttatatgttttcttatgatgcaagggcatactcttatgcaaataattaaaacttcataggtcttaatttcccatatctctatatattattatgacctatccaactggtaaccctatgaacaccttaaaataaacttgtatactcttatttaggtgagtttttcttgttaatactattattattgctatctaattgaatacttgaaggaagttgtgtgaaagaccttggctttgattttagttcttatattcttctagtttttgaaaataaaacacttccatcaacccgtaa

SEQ ID NO: 2930 - DNA, 6205 bp, Homo sapiens
attcacaatgaatgtgaaattaaaagcatgatgtagtagtgacccaaaaggaatgtgaattctcctccagaacatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaaatcctgtgtagtattggctatgtctcatctcttgttttcttgacatatgtgatttcattcatttttcgcaatgggagaaaaaatagtggcatttggtcatttttcttcttaattgtggtcatcttctcgatagttgctactgatctaaatgaatatggatttctagggctattttttggcaccatgttaatacctcccttcacattgattggctctctattcattttttctgagatttctcctgattccatggattacttaggagcttcagaatctgaaattgtatacctggcactgctaataccttaccttcattttctcatttttcttttcattctgcgatgcctagaaatgaactgcaggaagaaactaatgagaaaggatcctgtgttcagaatttctccaagaagcaacgctatttttccaaacccagaagagcctgaaggagaggaggaagatatccagatggaaagaatgagaacagtgaatgctatggctgtgcgagactttgatgagacacccgtcatcattgccagctgtctacggaaggaatatgcaggcaaaaagaaaaattgcttttctaaaaggaagaaaaaaattgccacaagaaatgtctctttttgtgttaaaaaaggtgaagttataggactgttaggacacaatggagctggtaaaagtacaactattaagatgataactggagacacaaaaccaactgcaggacaggtgattttgaaagggagcggtggaggggaacccctgggcttcctggggtactgccctcaggagaatgcgctgtggcccaacctgacagtgaggcagcacctggaggtgtacgctgccgtgaaaggtctcaggaaaggggacgcaatgatcgccatcacacggttagtggatgcgctcaagctgcaggaccagctgaaggctcccgtgaagaccttgtcagagggaataaagcgaaaggcaggtgattcgggccacctttagaaacacggagaggggcgccctcctgaccacccactacatggcagaggctgaggcggtgtgtgaccgagtggccatcatggtgtcaggaaggctgagatgtattggttccatccaacacctgaaaagcaaatttggcaaagactacctgctggagatgaagctgaagaacctggcacaaatggagcccctccatgcagagatcctgaggcttttcccccaggctgctcagcaggaaaggttctcctccctgatggtctataagttgcctgttgaggatgtgcgacctttatcacaggctttcttcaaattagagatagttaaacagagtttcgacctggaggagtacagcctctcacagtctaccctggagcaggttttcctggagctctccaaggagcaggagctgggtgatcttgaagaggactttgatccctcggtgaagtggaaactcctcctgcaggaagagccttaaagctccaaataccctatatctttctttaatcctgtgactcttttaaagataatattttatagccttaatatgccttatatcagaggtggtacaaaatgcatttgaaactcatgcaataattatcctcagtagtatttcttacagtgagacaacaggcgatgtcagtgagggcgatcatagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttatttttttgattaaagtataaattaagacaccctattgacttccgggtaaggggagtcaattgattacccagcagcacagtatttgctttttataattccctttttaaatacttgttcttaattcactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaagaaaacgtgacacatatacaccatggaatactatgcagccatagaaaaggatgagttcatattcttcacagggacatggatgaagctggaaaccatcatcctcagcaaactaacacaggaacagaaaaccaaacaccgcatgttctcactcataagtgggaattgaacaatgagaatacatggacacagggaggggaacaccacaccctggggcctgttggggggatgggggctaggggagggatagcattaggagaaatacctgatgtagatgatgggttgatgggtgcagcaaagtaccatggcacatgtatacctgtgtaacaaacctgcacattcagcacatgtatcccagaacttaaagtataataaaaataaataaataatttcagtaagaacctgatcaagttgaacatgtatatatatgttatacacaagtttgaaacatatttctgtttttatatgttttcttatgatgcaagggcatactcttatgcaaataattaaaacttcataggtcttaatttcccatatctctatatattattatgacctatccaactggtaaccctatgaacaccttaaaataaacttgtatactctt

SEQ ID NO: 2931 - DNA, 3581 bp, Homo sapiens
attcacaatgaatgtgaaattaaaagcatgatgtagtagtgacccaaaaggaatgtgaattctcctccagaacatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacctatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacgtcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaagaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggatttctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagccttgttgagctggaacaagttttgtcttccttccacgaaacaaggaaaacaatcagtggcgtggcgctctggaggcagcaggtctgtgcaatagcaaaagttcgcttcctaaagttaaagaaagaaagaaaaagcctgtggactatattattgctttttggtattagctttatccctcaacttttggaacatctattctacgagtcatatcagaaaagttacccgtgggaactgtctccaaatacatacttcctctcaccaggacaacaaccacaggatcctctgacccatttactggtcatcaataagacagggtcaaccattgataactttttacattcactgaggcgacagaacatagctatagaagtggatgcctttggaactagaaatggcacagatgacccatcttacaatggtgctatcattgtgtcaggtgatgaaaaggatcacagattttcaatagcatgtaatacaaaacggctgaattgctttcctgtcctcctggatgtcattagcaatggactacttggaatttttaattcgtcagaacacattcagactgacagaagcacattttttgaagagcatatggattatgagtatgggtaccgaagtaacaccttcttctggataccgatggcagcctctttcactccatacattgcaatgagcagcattggtgactacaaaaaaaaagctcattcccagctacggatttcaggcctctacccttctgcatactggtttggccaagcactggtggatgtttccctgtactttttgatcctcctgctaatgcaaataatggattatatttttagcccagaggagattatatttataattcaaaacctgttaattcaagtggtcatcttctcgatagttgctactgatctaaatgaatatggatttctagggctattttggcaccatgttaatacctcccttcacattgattggctctctattcattttttctga

SEQ ID NO: 2932 - DNA, 3857 bp, Homo sapiens
cgcctggccggcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcagctgcggttggatttctcacgatgtccagtgttatctccatgtctgcccctttcttcctggggaagatcattgatgtcatctataccaaccccactgtggactacagcgacaacctgacccgcctctgcctagggctcagtgccgtgtttctgtgtggtgctgccgccaatgccattcgtgtctacctcatgcaaacttcaggtcagcgcattgtgaataggctgagaacttcattattctcctccattctgaggcaggaggttgctttctttgacaagactcgcacaggagaattgattaaccgcctctcatcagacactgcactcctggggcgctcagtgactgaaaacctctcagatgggctcagggccggggcccaggcttccgtaggcatcagtatgatgttttttgtctcacctaatctggccacctttgttttgagcgtggtgcctccagtgtcaatcattgctgtaatttatgggcgatatctacggaaactgaccaaagtcactcaggattccctggcacaagccactcagctagctgaggaacgtattggaaatgtaagaactgttcgagcttttgggaaagaaatgactgaaatcgagaaatatgccagcaaagtggaccatgtaatgcagttagcaaggaaagaggcattcgcccgggctggtttctttggagcaactgggctctccggaaacctgatcgtgctttctgtcctgtacaaaggagggctgctgatgggcagtgcccacatgaccgtgggtgaactctcttccttcctaatgtatgctttctgggttggaataagcattggaggtctgagctctttctactcggagctgatgaaaggactgggtgcaggggggcgcctctgggagctcctggagagagagcccaagctgccttttaacgagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggaactattagtcttgatggccatgacatccgtcagctaaacccagtgtggctgagatccaaaattgggacagtgagtcaggaacccattttgttttcttgctctattgctgagaacattgcttatggtgctgatgacccttcctctgtgaccgctgaggaaatccagagagtggctgaagtggccaatgcagtggccttcatccggaatttcccccaagggttcaacactgtggttggagaaaagggtgttctcctctcaggtgggcagaaacagcggattgcgattgcccgtgctctgctaaagaatcccaaaattcttctcctagatgaagcaaccagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaacttta

SEQ ID NO: 2933 - DNA, 3016 bp, Homo sapiens
ccgtggagcgcggtgcgagtccaacaccgagcattcccgtgggcctgcagttggcaggagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgaccagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctggggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtgcgag

SEQ ID NO: 2934 - DNA, 1258 bp, Homo sapiens
attcccgtgggcctgcagttggcaggagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgaccagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctggggactctggccttggtgctggctcttccctgcagacgccgggagcggcccgctggtgctgattcgctgtcttggggggccggccctcgcatctctccctacgcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccagtgaacttgctgactgagaaggcaccttggaactctctggcctggactgttaccagttacgtcttcctcaagttcctccaggggggtggcactggcagtacagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccg

SEQ ID NO: 2935 - DNA, 2834 bp, Homo sapiens
gggcctgcagttggcaggagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgaccagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctggggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 2936 - DNA, 2377 bp, Homo sapiens
ctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagcagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattccca

SEQ ID NO: 2937 - DNA, 2353 bp, Homo sapiens
cgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacatt

SEQ ID NO: 2938 - DNA, 2116 bp, Homo sapiens
ctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatcc

SEQ ID NO: 2939 - DNA, 2302 bp, Homo sapiens
ctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattcccattttct

SEQ ID NO: 2940 - DNA, 2487 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagaaacacatggcgtaatgggaaaactggacagttacacaaggcagaaggagagtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 2941 - DNA, 2539 bp, Homo sapiens
gtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggaggctcctgcgtctgcagccgcgtgtcagccagaaggaggggacgctcggggtcagtgaccacgcccagtccgcactcccgaccgggggtcccctttcctggccctggaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggcaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 2942 - DNA, 4683 bp, Homo sapiens
gttgtcgggatgggggcgggagccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctcccaccagagtctgccagagtcattgggctgcaatgggcagagacagagttccacgagacacctccactctattctccctttgcccagacccctccagacctctcaagagacgttctggccagtctccctgccccacccagcagcttcaaattggccaggcctacagtagctccagggaatttttaaaaatcagggtctggaagtgggcctgggaattcaaacctaggctcttcccacacccttgctaggacctcacttccctagactggcgactgactccctctcctgtgtccccactccctccatgggagaaggagcctatcccctggctcaccccgggacccacagtccccatcttccaaacaacctccctcctttctccctgcacagtgaacacagtcctgatttctagatttcacctcccctccccacccacaagggacacaggcctaacagggcccaacacttgggtcagggtaggagggacggggccacaatggccagttcccacgagaagcgccagcctgcctggctgtcttccaccggccctgccctgtgtgcctggcgtctttcacccactgagattgtgaaccagcctccatctacaccaagaacacccagcactgaaggagatgggaggggctgatgcccacctggagctctctgcttcctgcccacagtgctgacgagtacagagctaaatggagcagctactgcagaatccagtacagaatcggtccaggagggtgcggctgtggacaggccagcatccccagcaggttctgggaggcgcaccttgaaaggggaaggcagacatcctgagtgatgggcgcctgtggccctgagactgtggatgagggggctaggctccagctggcttctgaggggcctggaaaggcacacaagtaggtccttggctgaactggtgccccagcaggacctcgtgtccctgcactgctgcagatgcatcagccctccccatgttggtgccgctgtcacttcctactgggatccttcccctatccagccacatccaggctgtgggactacacggtgccctgttcccctgggcaggagaagaggtggtacctgcaatgcaccttcacagccaggcaagcattctggatttaccctgtgtaaagaagggtggtaccctctttcaggggtgtgatacagtgcattgatggagcagctggtgctgctgggaggccagcctggaagaggcagcagtggctcaagtttgcgtgcaggagccagagtgggacccacgggctcttgtgggtgtggtttagaactagatggtgctttggggacaagccatccaaaaaccccaggcccacatccaccctgatttgatatcccacttcctgacagatcagaggctgtgtctttaagcagtggaggtccaggagcagagcctggggctggttcacagctaaacccctccttagggcagcccagagtagggcctcagctggcaagtccacaagccctgctggggccctgcttgttggcctgacccctccctcaccaggcagccagccaaggtggttcctgcttcacccactcagtcatcagcctcaggctgcccaaaatgcctctgacaccagatttatatcttctgggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcacataa

SEQ ID NO: 2943 - DNA, 2392 bp, Homo sapiens
agccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 2944 - DNA, 1596 bp, Homo sapiens
atgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaagcttcctccgtgttgcaccctgtccgaattcccttccgctgcaggctgtgacattccatgcatggaaggaccatccttgacaggctgtgtgagctgcccttccccatgcctgccacttccagggatgacaagctgacccctgtccccacacaccccacccttatagcttattgctttgcgttggtccaaaaccacccgctcagctgagcctctgggatgaccagagctgatcaccagacagctcaaggcgggcctcccccctcctatctctttccaagctaaacacaagcagttctacataaatatgttatggtaaataatgagatagtaa

SEQ ID NO: 2945 - DNA, 2350 bp, Homo sapiens
gtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccca

SEQ ID NO: 2946 - DNA, 1970 bp, Homo sapiens
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcct

SEQ ID NO: 2947 - DNA, 3515 bp, Homo sapiens
cgccccgtccatcagcctgtctcaacgcacgccagtctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccct

SEQ ID NO: 2948 - DNA, 3399 bp, Homo sapiens
gtcactgaggccccgccccgtccatcagcctgtctcaacgcacgccagtctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccct

SEQ ID NO: 2949 - DNA, 3791 bp, Homo sapiens
cacgcccccaaccgcgggaggcgcggaaccagcggccaaggggccgctctaagttcccaagggcggaaaaggacgaagacgcacctcgccaggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctctta

SEQ ID NO: 2950 - DNA, 3799 bp, Homo sapiens
cacgcccccaaccgcgggaggcgcggaaccagcggccaaggggccgctctaagttcccaagggcggaaaaggacgaagacgcacctcgccaggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgtccccgcagatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctctt

SEQ ID NO: 2951 - DNA, 3330 bp, Homo sapiens
gccccgccccgtccatcagcctgtctcaacgcacgccagtctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccct

SEQ ID NO: 2952 - DNA, 6051 bp, Homo sapiens
gaagaggaggaggagctggatcttgttctcctccgggccttctgcttgcttctctctgtgatgcagggagaaggtgaggctggaaggccaggaggggaagaggtaaaccttcgtcccctgctctggcctggggcaggcacagaccggctacagggtgagcgcttcctgaggggctttccagaacagagatggagcttcccagaggagccccttcctggctcctgcggcgcctggccctcacatctcaggcccggctgcacagaggcatgactgagcgtccccgaccactgctcgcccgacttccccgggtagtaactgcgcctcctctccccgatgcctgtggtcctcaccctccgccccaggggccgtgctggccttgcgaccttgggatgtggaggccgagcagttcctcgaggtgtctttcctgctcttcttctttctcttttccgacccccgtccccgggaccggctgcgactcctcgagcgcttgcgggagccgacgtgagccatggcgccgcgggctggcgacgaagaagacgcgcttgagccgaagcccccaaggccggccgcgggcgggctccaagggtggctctagcggggccggggcctggcgacgcccagtacccgtcaccgtcccgggaaaatgagcgaccctcacccacccccagcgctggggaccccggttttctccgccgactccagtccccgcagcggtgcctgttaagggcccgccccgtgcccggaggccccacgcctgcgcacccggctccaaacccctgggaactggccgccgtccgccgcgagtggcgtctggggcgctttcccgcgctctcctaccctccagccccgcgcccttcgcggcctcgccgcctcaagggggcccccggggctgctccgttcccacctcgaccgccctgcgggccggacagcccgccccgcgccttctcgagaggaagcggcggcgaggaggcttccggccggggcgctgcgcgggaggctggccggctgggaagcgcggcgccgctgcctttcgttctgacgccccaggttccgtcccgggcgcgcccacctcccgcagaggcaagcaggggcgccggccctcgagctccgcagcccctcacgcctgtgtctgccgaagctgcgcccacttccaaggctgccctctcggcgcacgcccgcagcacccacgcccccggtgccctgggaagaaggcgaccctcgcgcgcgccgccctcctccccggctggtcctgccctctccatacgactgcgagctccagactgaggcgccctggtctttccgacgcgcccacccagtgactcagaggtcgcaaactcgtgtccgtaggggccagaaagatcttggcagtgagcgcgggcatggaccccaggcccatccggaaggaagccaggattctgctccagctgatacgtgcaacgtggcatggggctggtgccccaccttcccagggagaccaaactcaagactgcaatatggaagccccctgagtttcaaatgtgtaacccaaagcgtggctgtgcgcttcatccaatctcgggcccccaagttgcaactcttccacaatgacagccgcaaacacaaagggatcttgcaaagcactttatatacgtcagcgcatttgactcccaaaacagctctaggaggtaggtgctaaatgaggaaacgaaggcaccaaaaggtgaaggctcacctaaagccacacagctggaagtggcagaagcagaatgggaacccgggcagcctggttcctggccctgccattcacccctctgccatctagaagatgctactggtggcccacccgagtccactggggggtgatgcctgctgctgagggttcacatctgtgctctctggaggcttcccttggctactggaaggcaccctgccctggagataagtgtctgggaagttattcactcctctctggccccctcatccaggagccagtaaccggtggtgtgggcacactgtggtactgtgggctctgcctggagctctccgtggggccagctgaggctggacgtcctctgaagccacttccttgcccagctgctccctcccctcccctgcttccctgactccctcgctgaagccccattccagaccctgcttctgacaaacctgaactaaggcagcatctttgcccatagaatgacccagaagctggcacaccgttgagccaagaagtgcagtaggctgcggggattttatttctgcccccagaccaaggcaacggagccctcacctgcctgccacccccacactgggcccaagcaagctcaggtgagcgcacatacatccaccgtggcgggctcctctcgggtgaagccatcaccgaagccctcatcgtccaccaggtcgggctcacggcagcacatgggacagaggctgttgcgcacagcagaggctcggagccagacgacaaggttccaacgctcaccagtgcccaagggccgggctccatgcagctggccgccacggtggaggacaccctggcccaccacgtgctccacctccaggggctccgtcagggctgtgggtgcctgcagatggcacgactcaggcctgggcactcacagctgccccaggccctgccgcatgggtcacacactcacctggaagaggcccccaaaatacagggcgccccctgtgaagaccttgcccaaggccacattgagggtgagctcggcattatcatagtggcagcccagctccaggtcctggcccggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctctt

SEQ ID NO: 2953 - DNA, 5088 bp, Homo sapiens
ttctaatgatcccatcaccaaagtagcaaacgtagtacccaggattttttttttcctagttagtcttcatgttaagtacaatcttacctcaaaattgttaatgtctgtggtttaaaaaaaaacatgaatcagaaatggtgtgggtagtttagaaaatgagttaggttcaggtggccggttagctcagttggtcagaaaatgagttaggttcatctgggaagacttcctgggagaaaagaccctgggttctgaggtaaagtggagtagggataagatgtgcaaggcaggaagggagttgattccttaggtaagtgaattattggaggtgaggggtatgtctggctcctgagtcagccacgatgtgcctccttgtcttcccccttgtccccaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagattgtggtagattaggagcccaaatcaagtggcttctctgttcagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgt

SEQ ID NO: 2954 - DNA, 5033 bp, Homo sapiens
ggcgaatagcgccggctaggtcttccaacctctaggtggggtgccagccggggcgggcccagcaccccggccgggcagtactttttttttttttgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgtgaggc

SEQ ID NO: 2955 - DNA, 4463 bp, Homo sapiens
gtgtatttgaataaaccaggttggcaaatcatactatagctgaaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 2956 - DNA, 4612 bp, Homo sapiens
gtcacctggatagcgcaaaggaaacaagagaaaggaacagagcccctcttctggcctctgggctaccatacagaaaagcagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 2957 - DNA, 4862 bp, Homo sapiens
actgggataaagcaagaagactgattttatgagcaggggtttgatacatcaaaggagattgcccaggatcaagggtgcggtgttgggggtgggttggggagggtggttagagaaggtttcactaagtgatttgggcctgaggcctgagaagatgtttaaaaagagggatcaagcacaggctaaggagaggaaagagcaggcacccaaacctctgcatggccccaatatgctccctgcagggtagtgccccctcttctggctgctcaaggcgagatctaagcttcttctaactcctgctgtcttttcatattctctgattctgggaaacgaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactc

SEQ ID NO: 2958 - DNA, 4576 bp, Homo sapiens
gtgtatttgaataaaccaggttggcaaatcatactatagctgaaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactc

SEQ ID NO: 2959 - DNA, 2942 bp, Homo sapiens
ttaaaaaggctcctgcaggcaacatgcctgcacactaacgtgcagaaagggactgtactactcaaaaccaccaaggaagtggcagagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatg

SEQ ID NO: 2960 - DNA, 5168 bp, Homo sapiens
gccttggtcattggaccggctcccaaccaaaaccacaccatagggttttctgctcttggccaacccaacatgagaaaagaggaattaaatggtcctactaataagaaagcctcagcgtagcattaagggacgtagcaggtcttctggccacactcccctacaaatgtggaaagctcattggtgaaaacagttctcaggggtcaaagcaaaggaactgatctgggtaaagtagaggctgcctgatcccaatcagacatcctcacctctcaataacctttgccatttctctgccatagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccggtgattctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctggtataatcgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctatcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattctagaggaggaagaggctctgtgagatgaataggaggagtcttcaggaggaggggctgtcctctccgcaggcagccctggtcttcagcccctcccatccacggagtgagctggggctgaagttgtccccactgccatactcagtccatgtcaccccacttggtgggcttggggttggttctgggtggtgaaccggggcagacccagctaatggattaaaaaactgcccttcacctcccaaatccccaagggttcctcatgtgttttcaccaaaaccaccccagtgcctgagattgaaaatattgtaactttcagttagaaatcagccacaataaacaacatgggaaaatgccttaggatggagtttgcaaggtttccttgcccattatcagaaggaaaaagagcagaattttcttctcgtttaaccccactcacttccatcttgactgggtgacaagtggtaatgacacagatttgtagcgtgaaagactgaatacagtgtttggccaaaaatttttttaaaaatcatattatatgtttcaattgatctgttagaataaccaagaaaacaaaatgctggagtttctctataaatgacacttttatatcttctttattcgtcgttaaaacgcggtaggaaattaccctgaaatgtcgccttgcaattatttcactgaagatattccaatttccatactatttcctccaatagacccttgttgcct

SEQ ID NO: 2961 - DNA, 4053 bp, Homo sapiens
atcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctagtttaagacgctaaacgacgaaaactccagtcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattc

SEQ ID NO: 2962 - DNA, 3899 bp, Homo sapiens
atcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagcattttccacagaggagtccaggagctcaagaaggtggagaatgtcagccggtcaccctggttcacccacatcacctcctccatgcagggcctgggcatcattcacgcctatggcaagaaggagagctgcatcacctagtttaagacgctaaacgacgaaaactccagtcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattc

SEQ ID NO: 2963 - DNA, 3889 bp, Homo sapiens
atcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctggtataatcgttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctagtttaagacgctaaacgacgaaaactccagtcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattc

SEQ ID NO: 2964 - DNA, 544 bp, Homo sapiens
agttggagaggaggacttcaggcgggtgggacaagagaaactgaatctgaggtccttggggagaagcaggccctggagtcctgggcagcagatgccaggctctgagccccatgactgctgaccctcctcccctccctctcatcctcagcccaggtaaagcttcatttccagcccagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcct

SEQ ID NO: 2965 - DNA, 1224 bp, Homo sapiens
agttggagaggaggacttcaggcgggtgggacaagagaaactgaatctgaggtccttggggagaagcaggccctggagtcctgggcagcagatgccaggctctgagccccatgactgctgaccctcctcccctccctctcatcctcagcccagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccct

SEQ ID NO: 2966 - DNA, 1714 bp, Homo sapiens
tttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggctacctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggtaactttcccttgagtgtctgtgtgagcgcgctgcatgtttcaggcaagggtacatcagcatcatggcgattctgtccttacatttttatagcacttcatacttctcagtgcacttcatattattaatggtattcacaatactgatactaccttagtgatggatacatggcgtgtaatgtactgttctctttcctttggggtacttttgaaattttccagaatgaaacgtggttttgaaaaaaataataccttagcatttctagattttgcaccttggtacaaattagcataagcaggcaatttgttgattcattcacttgaaaatatttattgagcacaactgtgtgtcagtgaccattctgggcactaaaagattgctcatcttttgtgagctagaaaatatgtagtaagcccatacataggttactctttgaaagtaataatagctattaagaaaataaaacaatagtgtatttggagtgaagtgcgacttgagacagggtaacaggggaagcttctcagaggagatgacatctgaacagacactcaaatgatgagatcaggccctctgagggacagtcagagggaagtgtgttccagtcagaaggagcaggcatgcgaggctgagaggggaacacatttggcttgctcagggaatggcaagaagatccaggacagggtgcgcatggggtgagatgggctcaaggaagtggacagggattaagctatgtggacccctgtgggccacaataaggaatctgga

SEQ ID NO: 2967 - DNA, 5312 bp, Homo sapiens
acatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggctacctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattgtctacctcgatcgtacttccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatgg

SEQ ID NO: 2968 - DNA, 5166 bp, Homo sapiens
gcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagta

SEQ ID NO: 2969 - DNA, 1881 bp, Homo sapiens
gcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccg

SEQ ID NO: 2970 - DNA, 5271 bp, Homo sapiens
ccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagta

SEQ ID NO: 2971 - DNA, 5837 bp, Homo sapiens
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccattca

SEQ ID NO: 2972 - DNA, 5702 bp, Homo sapiens
gagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccattcaga

SEQ ID NO: 2973 - DNA, 3063 bp, Homo sapiens
gagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctaggctcaagcaatcctcctccctcctcaagcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcacctatttaagtgtcttaacaatttttctattgagtactctgggtttttgttttgtttttcttactgatttgtagaattctttatgtattctgaattgcagataccttccttctgtactaatgcttatctttttagccctgtaatattgtgttttcataaacatacttatcaatcttt

SEQ ID NO: 2974 - DNA, 2840 bp, Homo sapiens
gagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctaggctcaagcaatcctcctccctcctcaagcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcacctatttaagtgtcttaacaatttttctattgagtactctgggtttttgttttgtttttcttactgatttgtagaattctttatgtattctgaattgcagataccttccttctgtactaatgcttatctttttagccctgtaatattgtgttttcataaacatacttatcaatcttttc

SEQ ID NO: 2975 - DNA, 2256 bp, Homo sapiens
gcgcccgccccgcccggcaagatgctgcccgtgtaccaggaggtgaagcccaacccgctgcaggacgcgaacctctgctcacgcgtgttcttctgatggagtctcgctgtgtcacccaggctggagtgcagtggcgcagtctcagctcactgcagcctccacctcctgtgttcaagcagtcctcctgcctcagccaccagactagcaggtctcccccgcctctttcttggaaggacacttgccattggatttaggacccacttggataatccaggatgatgtcttcactccaacatcctcagtttaattccatgtgcaaatacccttttcccaaataacattcaattctttaccaggaaaggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagt

SEQ ID NO: 2976 - DNA, 4283 bp, Homo sapiens
cactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaa

SEQ ID NO: 2977 - DNA, 5921 bp, Homo sapiens
gccgcgtccgcagccctgggcactcggaaggaggactacagttcccttcagccttgggaatgctttgtgcagcgcgcttgcgcggtgtggcggccgatgccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttgtaaaa

SEQ ID NO: 2978 - DNA, 1923 bp, Homo sapiens
ggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccaaattttcaggatggctgtattctgcggtcagaatgagagagtcaagctgggcagaatctctcgccaagagttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttttggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 2979 - DNA, 5836 bp, Homo sapiens
cttgcgcggtgtggcggccgatgccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtcatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttgt

SEQ ID NO: 2980 - DNA, 1848 bp, Homo sapiens
ggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccaccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttttggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 2981 - DNA, 4697 bp, Homo sapiens
cggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagtaagttctaaccatcctttccgacagtctccaggggcccggccacggccagctctaacactcttattctgttgcagaggttgtgctcagctttgggctaggtagcagtcttagagatgccttcaggtctgttgaaaggggtcgatggattttggcaacagctggaaggatgaaagggcagtgttgccagagaagaaatggaactggcttgatttctgggtgggggtgaaatggaactgactccagttctgcacaggactgtgcttctcggttgtgtgttaacatgaactgacagtcggtgcaggcagatgtgtcttgcagtgctatgagtgggtgagagcacgttgtgtggcccgggctggtgagccagcaccgggaacataccaagtgcctggaggcagttatcacatgtttggcaggtctgtggcaaataagccctgagaaaactagaggactgtcgaggattttagagtctgacctggagtccgtttaagtttggcttatagtgtgactgtgtggcaagtgttggggtggcagccgtggttttccccagtctgtactgatgcagagtagacaagagagcctttgacgttcactctgtttcctgggcacctgtttcttacacctgctgtgctgccttacacttgagaccttgattaaatctattctctacacatttgccttgaggcatcggagcagtagtactgcttgtactgtgcgttttccatatgtgggtaagctggaggttcatggttttggtaagtatgtgcctaagatgcatggcaattaggtaaaactaatttgcagttttgtttttgtttttatttttttaacgtttgatgcctcttgttaaagttttgatctcttttctgaagcagagaacactacttttctggtattgggtttctatattattaataattgaccaactaacatactttatataaaagttttaagtaagaaggaccatgtaactgaaatgttgtgttatgtaatttaccaaaatggcaaacattttcatagagccagcttcccccaagaagagcttctgtcattgtttcactacagggctggtggctgctctgatctcatagaattcattcctctgggtagcaccatatgcaggctttgcgaataaagtgatcatgggctttcttgattccatttggccaatgcaagaacttcattggctcccctctaaaaaaaattccatggattgctgggatttttattttttattttttgaaaaaaatggtacctatccgtattcagcttggtggcttcacagtccctcccctgaacatccgtatattccttattctctcatttatggtgcagaacactggggtactaacctctaggaaactgttctagctgccagggaaagctaagagccctcctttaacaggaaagcagcagcatgctttttcttctctctgccgtttcagggaagagcaccttaaggccagtgttatttcatgggattctgccctagagctgagaaagtaatggactcatccataatctcttttatagatttgaaagtgtaaacaatacacacttccttttttggaactccaattctaatatgtttctttttcattggaaattgaaaaaccaggctggttttgagattagtactagcagtgagtaaacctcctgtctgtggacttaaatccttttgaggaacatttcgttttagatttttacaagttttctaatctggcacgactttcaaactagcttaatctgttcttacagaaacctgtgtaaggacagactgcccacatacgggctccccaaataaaatggcatttttatttcttgtccctgctcgggtttcaccgaaccttggtagccataatcagaacaaatgaaacacagtcaagttgttgtgttctgtttgtttttacctgccagccagctgatgctgacatttatacaccaagatgatccaaggttttggtgacgccggtggggactgccgctatatgtgcagggtgcccgggggtcatagtaatgttaatggagtaccagaatctctaacagtgtggtcctgtgtagccacattgctacacttacagagatgctttggggcctttttggattaagacagttctaaaagaccaggcctcacctatgatctgtgtataaagaattagcatcgcactgtagatctgcaagagaaggccgcctcctgcagtgctctctcttggtgaatgctaactctgctcgagggccttttggggaaaggacagtgtaaaacccttagagaggtaagtttcccacccttccaacctctctccacctgcagcttgcttggtgctgtcaggatctggatttggggggagtctctctgtagtggaaccagtgacagaagctgttctttagaattttcaggatggctgtattctgcggtcagaatgagagagtcaagctgggcagaatctctcgccaagagttcaggtaaggtaatgtttattcactgggaatgctttccacagccagacagctatgctaacagtctcaagttttcttccagtttgtttagatttaaatgatacatttgtaactttttaaaaactaaattttggttggatttttcatgaaaacctcttttttctttatcccctaaaaaatggtttgaaatgtcattgttatttaaaaacccgatgtgttggaacttctttaatctgctgtttcctctttttccccccctttgaaagtttcgcatagtgtaaacattcactatgtcttttaccttccctgctcctcccatctgggaggcgctgatgctattacccagtgctgaaaaatggcactctaaaggtatgggaaggaaggagcccaaggcaaccacctgctgtcctttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttttggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 2982 - DNA, 591 bp, Homo sapiens
cgggtctgagagaaacgcccacctgggaggctgtgcagcgggtggctcggggcaccctgctcaacccgcagcggagccgccagcgaccttcgaagaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaa

SEQ ID NO: 2983 - DNA, 2000 bp, Homo sapiens
ggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccacttgcttggtgctgtcaggatctggatttggggggagtctctctgtagtggaaccagtgacagaagctgttctttagaattttcaggatggctgtattctgcggtcagaatgagagagtcaagctgggcagaatctctcgccaagagttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttttggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 2984 - DNA, 5110 bp, Homo sapiens
cgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtggactactccagggaacaacacggattctcgtgacgcacgcactccacatcctgccccaggctgattggatcatagtgctggcaaatggggccatcgcagagatgggttcctaccaggagcttctgcagaggaagggggccctcatgtgtcttctggatcaagccagacagccaggagatagaggagaaggagaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcagagcctgtatgtggttagctcatgccagctgagacgcttggagtcagccagctactcgtctgtctgctcccacatggctgagacgttccagggcagcacagtggtccgggcattccgaacccaggccccctttgtggctcagaacaatgctcgcgtagatgaaagccagaggatcagtttcccgcgactggtggctgacaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctgagccaggaccctcaaccgtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccggctagacccttaaatcagaatctctgaggctgggaactgccatgctgtgtgtactttttacaaattaacacttttattttgggataatcccagactcacatgcagttaaagaaacaataatatagagagattcgtgtacttggtaccccatttcacccaatggtaacatcttgcaaaactctaggataaagcatcacagccagggtgttgacattgacacaacaatcttgctcgatttcccgttttacctgta

SEQ ID NO: 2985 - DNA, 1762 bp, Homo sapiens
ccctccccagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactgccactgtggccatcctgccactgtttctcctctacgctgggtttcaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctgagccaggaccctcaaccgtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccggctagacccttaaatcagaatctctgaggctgggaactgccatgctgtgtgtactttttacaaattaacacttttattttgggataatcccagactcacatgcagttaaagaaacaataat

SEQ ID NO: 2986 - DNA, 4137 bp, Homo sapiens
atggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtggactactccagggaacaaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctga

SEQ ID NO: 2987 - DNA, 2272 bp, Homo sapiens
agtctgcccagagacttagcgacagacagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtagctgccatccctgggagcctggaaccaggcaatgtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagagtcttgctctatcacgcgggctggagtgcaatggcatgatctcggctcactgcaacctccaccttccggattcaagcaattctcctgcctcagcctcccgagtagctgggattacaggcgcatgctaccacacccagctaatttttgtatttttagtagagatgggttttaccatgttcgtcaggctggtctccaactcctgacctcaagtgatccacctgcctcagttccc

SEQ ID NO: 2988 - DNA, 8293 bp, Homo sapiens
atgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcctaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgttcctgctctccacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttcagccaaaaactataaacaggaaacagcctggaagatatcacctggacagctatgagcaatcaacacggcgtctacgtcccgcagaaacagaggacattgcaataaaggtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaacttgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttcgaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgttggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatagctcatcgagtacacactattctgacggcagacctggttattgtgatgaagcgaggaaatattttagaatatgacactccagaaagcctcttggctcaggaaaatggagtatttgcttcttttgttcgcgcagacatgtgaaggagtgtcttaaaacaatacatgtatttaaaataatgcagtcataacctaattaatggatcatcagcttgacctctgtaaagtggcatcttaaaacttttacagatttttgcacaaaaagtggacatttatttttcctgtttttaaaacagtttttcaagatattattgcttaatatgttcattattgatgtttttatagtgatccagccactctagctttaagaatagctaggttgtattaaaacatgtaagctactttaagtgataaatcaatagctaaagttttctcctaactttaagtctggtaaatatctctcaggaatggaagtgtcaatgagtagtcagtattactatactcttgtttgtaagaatatattttccttattgttggagtctccagaggttattggaaggaataaaaaaggacatgttttctaacgaaactctcaaattcattatctacttcatgagaatttatttgtattcattaacattagtaatacctatttttcttaagagccttcttttttcccttttgtttcttgtcaccaagaagttatcacacttatacttattctataaggccaaagccttatctagaaagatcatgaagagtttggatatttttaaaactatactcgaattttcattttttcctgtcctgtaaagagagaattcttaagatatcaggcataatgtatgtaccttttccagactgaagttcaaagaatgattaggttcaatctttcagtggcaggccagctaaactttctatagtttaatgattagctgtggttatgatcttgagccctaacatgccacattactcaagatttacacaggcaagtgacttcatttggcactgctaataatggcaggtgaacattcctctcaggtgtgagatatttcctatgaaacagtccactggcaggctggagatatcttacactttgaagttatatatatataaaacaagtgtctatttctagctgaaagagtttacctcttctagacatttatgcccaatggtgtcacacatgatcatttgctcctgctctaattttaatgtgcatacaaaaaatataccaaaaatgttattgtaattttaatgagcatgtaaagagtgtatcaaaaattgatgggatattagtgttaggttttgcttaaatgaaaattaataaattcaaaaatactaaaagtcaccttctttgtcacgttagcaaccagtttctactattctgtgcccatccagtgtcaatatcattgatttctttttcatatgaagatccacatgcattgtaagattgtgaagatatataaaattgatgaattaagagaaattatgccactttcctatagtttctgtgttctgtttattgtatggtgtattcactcttggaaaatatgtaatagttgtgtatccagaatatgtgtcttcacctgaatatttaatctttatatttacaaaaaaataagttccacaagatggacaaaaatggtccatgatatttagcttaaattgtaaccttttgttgtgtatataaaacttccttggaagaaaataaccttattgttttcttaaagctaaacagaataggattggtactcattaattatgtcttgcaaatattttctaaaaattcaaccactctcctaaaatggtgtttaaatattttgtagggcagaatatgcatattgcctgttagcaagtaataattcattctcatagagaaatgggtttttacccatggaagtaatcttttttttttcttttttttttttaattttttttttaatatactttaagttttagggtacatgtgcacattgtgcaggttagttacatatatatacatgtgccatgctggtgcgctgcacccactaactcgtcatctagcattaggtatatctcccaatgctatccctccccactccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttgtatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtaatcttttaatgatattttcttattatattgctacaggcaacatcagtagaagcctatctagttacactaaactaaagatcacattcaccattcttacagccaagtggttgctggtcccctcataacttttagttacttaagttgagtaaatgtctaattgtttacaaactaaattgactaaataaggtcaaggataatgtttttcattgattaaccatttattatacatataatctattgaatataaaaagattcaccttgaaataatatttgactatataggtacatatctgtaaaagatgaccaccttaactaaatcagattttacatttataaattttatatttaattagtcaaatcaatttttaaatcataactccttaatctcataagaagcaataaatgcataaagcattatattaaaataccagggttacttatgtcattgacagggaaaagactttgtataaacaattatgcaccatctatttttgtactcttactcatgatccatttaaaagtctactcagctctagattagataccagaagaccctctaagtaactgataactgagattcgggaccatgtcttgtttgccattgtgcccttggaatttaatacaagtgcctaacccacagtagggttgattgattcactgattagttttactgccatgtgcctataactataggttattctctttccttttctatgttgtgtttattctatttattctctacaatatataaaatgtatttgttctctacaataaatgtgtttattctctacaatatataaaaacatattggactactattacataattaaattactcttt

SEQ ID NO: 2989 - DNA, 4650 bp, Homo sapiens
atgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcctaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgttcctgctctccacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttcagccaaaaactataaacaggaaacagcctggaagatatcacctggacagctatgagcaatcaacacggcgtctacgtcccgcagaaacagaggacattgcaataaaggtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaacttgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttcgaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgttggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatagctcaccgtgtctcttctattatggatgcaggccttgttttagtcttttctgagggtattttagtggagtgtgatactgtcccaaatttgctcgcccacaagaatggcctcttttccactttggtgatgaccaacaagtag

SEQ ID NO: 2990 - DNA, 1693 bp, Homo sapiens
ggggaaggtctccggccccaggcgcggcgcgcggggcttctgcccagtttcctgcttctcagccgcggtgtctgccccggcccagagcagtctgtgcaatttagaaactcgataggaggcagcagctggtctcccaccaccctaaaaataatccgttccggcgcactgcgtgcttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaaggaaaagtattgtttgtgaccattgctaaatcaattatcaatgaaaggaaagaaagaaaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttaggttttagccatcatgagagtaaaagctgctatcaacattcttaagtattttgtggctatatgcatttatttctcctaggtaaatacctaagagtgaaatctctgggtcatacaataagtgggtaaatgttcatattttaagaaactgacatcttttcccaaaatgtttgtatcattttttatactcactaacaaggtgtaagagttccagttccacatgttcatcatttggtgatcttggtctaatttagtcatgctagtgggtgtgtactggtaatacattgcggttttaatttgcatttatctgattgctaattatgttgaacactctttgatgagtttattggccatttttaatctttgggatgtggctattcatatcttttgcccatgtttcattgggttgcacttttattattgcgttgtaggaatattttgtgcatactagatattagtatgtcatcagttacatgttttgataatgttttccttctagtctgtggcatacatattcatttatttaatagggtcttttaatgagcagaagattttaaatttcgatgtagtataatttatcatttcttctagtccttagttactgctttctgtgtcttaagacatctttgtcttccctctaaatatgtttccctcttattctcctgtttgcttttagatgctttatggtttccatttttatttttaggactacgattctttctaaattaattgtgtatatggtgtaagataggtgtcaaagttcttttttttttttttccaagtggatatcaatgtgttccagcaccatttgtgggatagactttctgtttctcaagagattgcattggcacttatgtaaaaaaaaataaatcaaatgactatttaaatttaa

SEQ ID NO: 2991 - DNA, 4562 bp, Homo sapiens
agtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcctaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgttcctgctctccacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttgtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaacttgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttcgaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgttggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatagctcaccgtgtctcttctattatggatgcaggccttgttttagtcttttctgagggtattttagtggagtgtgatactgtcccaaatttgctcgcccacaagaatggcctcttttccactttggtgatgaccaacaagtag

SEQ ID NO: 2992 - DNA, 3664 bp, Homo sapiens
gccaggctgcggagcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaatgcagtccttcctccctgc

SEQ ID NO: 2993 - DNA, 842 bp, Homo sapiens
gcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcaggtgagacccagggctccaagaggatccaggccaggggcctgtcccccataccgctgggtgctgagctcacgagggcccaactcagccagcccgccgcccacttctgctgccggggccaccgaggccctgctgccagccttgatgctttcagaggttgagctcgccttgcccctccttgttgccttttgccctgcgcgcacctcacgccctttgttaccactcagacaagcccaggactgcaagtcaggaacactacatgtcacttctccaggcacagataccctcacccacctgtccctgtcctcaaccca

SEQ ID NO: 2994 - DNA, 668 bp, Homo sapiens
gactgttctccacagtggctgccccattttaccttcccgccagcagtgttggagggttccaccttttcatcgtggctagcactgatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgac

SEQ ID NO: 2995 - DNA, 6238 bp, Homo sapiens
aaaacacaacagtggaagagaaacgctgcagactatgggacgctgtaggactttctaaaacatttgctggggatttctgtgaagcatgatcttttaaaacgaattcttttggaagccggtttgggtaactgggaaaatgacacatatgctaaatgcagcagctgatcgagtgaaatggaccagatcgagtgctgctaagagggctgcctgcctggtggctgcggcatatgctctgaaaaccctctatcccatcattggcaagcgtttaaagcaatctggccacgggaagaaaaaagcagcagcttaccctgctgcagagaacacagaaatactgcattgcaccgagaccatttgtgaaaaaccttcgcctggagtgaatgcagatttcttcaaacagctactagaacttcggaaaattttgtttccaaaacttgtgaccactgaaacagggtggctctgcctgcactcagtggctctaatctcaagaacctttctttctatctatgtggctggtctggatggaaaaatcgtgaaaagcattgtggaaaagaagcctcggactttcatcatcaaattaatcaagtggcttatgattgccatccctgctaccttcgtcaacagtgcaataaggtacctggaatgcaaattggctttggccttcagaactcgcctagtagaccacgcctatgaaacctattttacaaatcagacttattataaagtgatcaatatggatgggaggctggcaaaccctgaccaatctcttacggaggatattatgatgttctcccaatctgtggctcacttgtattccaatctgaccaaacctattttagatgtaatgctgacctcctatacactcattcaaactgctacatccagaggagcaagcccaattgggcccaccctactagcaggacttgtggtgtatgccactgctaaagtgttaaaagcctgttctcccaaatttggcaaactggtggcagaggaagcacatagaaaaggctatttgcggtatgtgcactcgagaattatagccaatgtagaagaaattgccttttacagaggacataaggtagaaatgaaacaacttcagaaaagttacaaagctttagcagatcagatgaacctcattttatccaaacgtttgtggtacatcatgatagaacagttcctgatgaagtatgtttggagcagcagtggactaattatggtggctatacctattatcactgcaactggctttgcagatggtgaggatggccaaaagcaagttatggttagtgaacggacagaagcctttaccactgctcgaaatttactggcctctggagctgatgctattgaaaggattatgtcttcatacaaagaggtcactgaattagcaggctacactgctcgagtgtacaatatgttttgggtctttgatgaagtaaaaagaggcatttataagagaactgctgtcattcaagaatctgaaagccatagcaagaatggagctaaggtagaattacctctcagtgacacattggcaattaaaggaaaagttattgatgtggatcacggaattatttgtgaaaatgttcccataattacaccagcaggagaagtggtggcttccaggctaaacttcaaagtagaagaaggaatgcatcttttgataactggtcccaatggttgtgggaaaagttctctcttcagaattctaagtgggctctggcctgtgtatgaaggagtcctctataaaccacctcctcaacatatgttttatattccacaaaggccatatatgtctcttggaagtcttcgggatcaagtcatttaccctgattcagtggatgatatgcatgataaaggttatacagaccaagatctggaacgtatcctacacaatgtccatctctatcacatagttcaaagagaaggaggatgggatgctgttatggactggaaagatgtcctgtcaggaggggaaaagcaaagaatgggcatggctcgtatgttttatcataaaccaaaatatgccttgctggatgaatgtaccagtgctgtcagcattgatgtcgaaggaaagatatttcaggctgcaaaaggggctggaatttccttactgtctataacacacagaccttctctttggaaataccacacacatttattacagtttgatggtgaaggaggttggcgctttgaacaattggatactgctatccgtttgacattgagtgaagaaaaacaaaagctagaatctcagctagctggaattcccaaaatgcagcagagactcaatgaactatgtaaaattttgggagaagactcagtgctgaaaacaattaaaaatgaagatgagacatcttaatttgttttgacatattttaaaagttaattattagataaaggctcaaagacattctgttatactgcatgaagtatgttaagctaagcacagagaaaaaaaggcagcaagacatgttttataagattttagcattaaggaagtatatgatctgacttttcagaagaaaataaacaaatgcattatgtaaggtcagtcattatgacttatactaattcctagtgaaggcctaatgcacttgtaaaacaggattttctaggtgaattcatgatgaataccagatttactatgtatatgtggtgtgtctgaagttcttaacaaacatgggcaatattctggaaatgaaacaagttaaactgagcagcatttgggttgataccaagtgcataagattcaaactttgagtgacatttagtccatttatggttgatattaggtttaatagctagaattcaaattgattattgctagtggccaactaaacctgtacaaaatagctgacagttttataaataatttcaatataaaaattgttttaatggcatttgttgaaagaaaaaagcatggctaaaatgtataaaatgccatatttttaaattttggactttaagcatcttaatgagggcatataacaaattaattttagtacaaatcttaaatatttttaataaatcctttcattttaaaaagagaattgccaatacagaaaaggagtatccaaacaatgtctcaacctgataatttccttagcagaattacctattgcaacttctgttcagaaatacacagcttgtttttttgcccaaggatgagtctacattttaagaactgcaatggtataaaggaacttaaggattctgagaatcatagtaataacatacattggaatagtactttataatttacaatccccatttacatcatttcaccttaatgttgatgacaatgttttgaaacaaatactatttttcctactttgcttttgagaaaattgacactcagacttgccctaatcatgcactttacttaaggaaagatcgagaaatcaaatgaagttctcctgactctctggtttagtgctcttttgttattatcctttaaatcaaactgggctataatagcaataaaagttagacgaagtgtagaaaataaaataaatttcataatgttagtcttattgttatttggttattgtttacaagaaatgaaaattaagtacaaagtgcaaagatcattgttctgcggcttaaaatgaaatgagaaagttagtaaatcattcagcaactatgcagtcttactcaatattaatgtacctctaaggcattagcaatgagaagggcaaataattatggttttggtaaagttaatatttattgaacataatgagaaataatctatatggactagtcatatgaaatagattttattctatttgtgtgcactggagctggaaagccaagactgaaactttatctcttgctgcctgtgataccacattgacataccagaagaatattggaatgatcagttgttagtggcctaggattttatttgcctgttgagacacagccataatagatgttaagtctgtgattcttagacttttcaggtgatagagtacctggaagtcattcataatgatcgttatagaacatcataacatttctacattttcaattctgccatgatagctagtgtatttttaattttcaataaatgtaaccaacttacatgaaggaatgcaatataaaattataatcagtacatttgtccaacgttttcattagtattatcacctacttattcatcagttactaatatttcctgttagaaaagtgaggcaggaattaaagatttttttttaagaagcatggaaccaaaacttaaacttgctaaaaattattcattaatcttttctacataagtgattatccagtttatactgctacaagggcaaaagtctgaggcaagtgttttaagttaacttttaaaggtacaagaagaaaatgaaaaatcctcatgtgaaagatgtgtataattttcatgccttaattttcataatataaaaataaaacataattttaaaacaacctgataattttgttttgaaacattgaaaagaatgccaaaacaaatattagatttgtaattagtcagtatttaatatattttacccatgagctaaagcaaaaaagactcattatttatgatgcacaggattcaaagatgcctaaaattctgtattaaaaactatgtacactgtaatttaaatgttaaagttctaatatgcacatgttttccatgagctttttgtgcctatttgttttctgaatttatttttcaggaccaacatccttaacttggaagggaaaacatctctgatttgaacttgtatttatgtaccattcaattgtttccaaatggtccaatgggtataccatattttactactcttatattttacggaaaacatgaaaaagactgagaaactagccatttttgaatacagcaagggatagatgaggaaaggaaaaaagaaagaatatttcaagtttcaaactacttttaccatgttatatctatttgcccaaacgtttgacatatttttggtcaaacaaaaagctataagtttatggagcttgagtttaaaatgtgcattctttaggttaactcttaaacttgaaaaataagttggattctatgaaaacgttgcattatatttctacagcatgtaatgttatgccaagcatgagtctaaaacagtttgtgttcttgtaagcaggataatgtgtaataatccctctgaaataatctcaagaagaatgatataccttaaaactcaactcaaatttacatttgtttacagtgggaatggttttctcttgatagaaatttggtttttgtctcaagttttggtctgtcagtaaaggcataaatgaatatcctagtttttatttgaaacattggttccaagtatagtttcatatttggcaatagattcatcttattctaatatgtttggaatagctttttgattcaatgagtctaggaaaatctgttacacattgaaacccaagtccagagaatgttacacacttctaatatatgcataaaatgatggtaaaggttattaaatcattgatttaaaaagatgactttgatataattactttatgggcaaaattgtcctcatttagaagtgaaaagtactttcacatagcctaggctatttacagttctgattatatacatttagatatgttgaatatgttttggggttgaatatgttttgccacatgagcgccttcaggtggatgtataaaatatttttttaaaaaccaatttcttcttcattgttgatgcttttcctgactaccaagttcagggctggtttacatttcatattgtgaaattttcaaaaccaatggtctatttataagccagaattgtattaatgaaaatgaatgagaaaaatgtccttaaaggtaaaaatcattatgtagctaaatgaaattgtggctgtgtgtgagtacattataatataatttccatctgatgtgtatttacttgaactcatcattccttatgaattccttaaccattaagaaaaagactagattaatcaaaggaattacaaattattccatttttacaaaataccctgtttctatactgcaaatggccatgttgggtatatgtctatatacgccttacttagacattgtattgtatataaccgtgtgtagaactatagacaatagtcaccaaatagttatttaaatattaattttctttattaatacaacacatttaataagtatctacctatgccaggcactgtgctaagttctattactaaataaaatttggtccctgtccgaa

SEQ ID NO: 2996 - DNA, 884 bp, Homo sapiens
atggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcaggtacttggaaaaattttgtggcattaaaaaccagacaaatgtattggccaggcgtggtggctcatgcctgtaatcccagcactttgggaggctgagatgggaggatcgcttgaatccaggagttcgagacaagcctggacaaaaagcgagacccgcttctttaaaaaataataataaaacagaagttcttaaaccatgaa

SEQ ID NO: 2997 - DNA, 3538 bp, Homo sapiens
cggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgctttta

SEQ ID NO: 2998 - DNA, 3286 bp, Homo sapiens
ctctgctctcctcccagtctcccccgcgctgcgtgcagtaaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgctttta

SEQ ID NO: 2999 - DNA, 2269 bp, Homo sapiens
agtaaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacgggtatttcatggaaacttggagagagaaaagtgatgaagtgatgggagagctgactgatcatgtgactcattgtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaa

SEQ ID NO: 3000 - DNA, 2480 bp, Homo sapiens
taaggtagccgccgccgccgccgccgccgcgtcccctcgccggctcgctggtaccggcagtgccatggcggccttcagcaagtacttgacggcgcgaaactcctcgctggctggtgccgcgttcctgctgctctgcctgctccacaagcggcgccgcgccctcggcctgcacggaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatt

SEQ ID NO: 3001 - DNA, 1770 bp, Homo sapiens
tctacccagtactgaactaggggcagctgggctccagagtccctcgggtctcaggtcatggcggtcgcggggcccgcgcccggagctggcgccagagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccagcggc

SEQ ID NO: 3002 - DNA, 3003 bp, Homo sapiens
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgatcttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttccaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatttttgccaggcttctgtacttctagtacttgagttacttaatatttttaaaaacaaaccttttaagtttaaatggatttttaagtgaaattttacacttaacatagatggaaagtaactaaaaataaatacaagaaaaacca

SEQ ID NO: 3003 - DNA, 1094 bp, Homo sapiens
atgcggagcctgctgctttctacagtcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccagcggc

SEQ ID NO: 3004 - DNA, 3921 bp, Homo sapiens
aagccgtgtcggcaccagactctgttggtcctactgacacctccagcgttagaatgactaaggctccactcctgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatggcttgcgcgtgcggcggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctg

SEQ ID NO: 3005 - DNA, 786 bp, Homo sapiens
gcttgcgcgtgcggcggctgggcaccgccattttggccggtggccgtgagaacacgctgtgtggctgaaaagtgaaggcaagagctgatttggcctctgtgctcccctccgcaaggggatcgttttctccagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaa

SEQ ID NO: 3006 - DNA, 3481 bp, Homo sapiens
cgggggcggggttggccgcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttggaa

SEQ ID NO: 3007 - DNA, 3131 bp, Homo sapiens
gcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgac

SEQ ID NO: 3008 - DNA, 3250 bp, Homo sapiens
gcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 3009 - DNA, 3381 bp, Homo sapiens
cgggggcggggttggccgcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 3010 - DNA, 1484 bp, Homo sapiens
ccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcacggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 3011 - DNA, 3249 bp, Homo sapiens
gcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 3012 - DNA, 1484 bp, Homo sapiens; identical to SEQ ID NO: 3010

SEQ ID NO: 3013 - DNA, 1074 bp, Homo sapiens
gccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatgg

SEQ ID NO: 3014 - DNA, 3381 bp, Homo sapiens; identical to SEQ ID NO: 3009

SEQ ID NO: 3015 - DNA, 3250 bp, Homo sapiens; identical to SEQ ID NO: 3008

SEQ ID NO: 3016 - DNA, 3249 bp, Homo sapiens; identical to SEQ ID NO: 3011

SEQ ID NO: 3017 - DNA, 1483 bp, Homo sapiens
ccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcacggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 3018 - DNA, 1074 bp, Homo sapiens; identical to SEQ ID NO: 3013

SEQ ID NO: 3019 - DNA, 3381 bp, Homo sapiens; identical to SEQ ID NO: 3009

SEQ ID NO: 3020 - DNA, 1074 bp, Homo sapiens; identical to SEQ ID NO: 3013

SEQ ID NO: 3021 - DNA, 3380 bp, Homo sapiens
cgggggcggggttggccgcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 3022 - DNA, 1074 bp, Homo sapiens; identical to SEQ ID NO: 3013

SEQ ID NO: 3023 - DNA, 1074 bp, Homo sapiens; identical to SEQ ID NO: 3013

SEQ ID NO: 3024 - DNA, 1074 bp, Homo sapiens; identical to SEQ ID NO: 3013

SEQ ID NO: 3025 - DNA, 1074 bp, Homo sapiens; identical to SEQ ID NO: 3013

SEQ ID NO: 3026 - DNA, 3250 bp, Homo sapiens; identical to SEQ ID NO: 3008

SEQ ID NO: 3027 - DNA, 3250 bp, Homo sapiens; identical to SEQ ID NO: 3008

SEQ ID NO: 3028 - DNA, 1483 bp, Homo sapiens; identical to SEQ ID NO: 3017

SEQ ID NO: 3029 - DNA, 2526 bp, Homo sapiens
gcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttgg

SEQ ID NO: 3030 - DNA, 1484 bp, Homo sapiens; identical to SEQ ID NO: 3010

SEQ ID NO: 3031 - DNA, 3380 bp, Homo sapiens; identical to SEQ ID NO: 3021

SEQ ID NO: 3032 - DNA, 3381 bp, Homo sapiens; identical to SEQ ID NO: 3009

SEQ ID NO: 3033 - DNA, 1484 bp, Homo sapiens; identical to SEQ ID NO: 3010

SEQ ID NO: 3034 - DNA, 2526 bp, Homo sapiens; identical to SEQ ID NO: 3029

SEQ ID NO: 3035 - DNA, 1950 bp, Homo sapiens
accgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctca

SEQ ID NO: 3036 - DNA, 1950 bp, Homo sapiens; identical to SEQ ID NO: 3035

SEQ ID NO: 3037 - DNA, 1950 bp, Homo sapiens; identical to SEQ ID NO: 3035

SEQ ID NO: 3038 - DNA, 1950 bp, Homo sapiens; identical to SEQ ID NO: 3035

SEQ ID NO: 3039 - DNA, 2526 bp, Homo sapiens; identical to SEQ ID NO: 3029

SEQ ID NO: 3040 - DNA, 2185 bp, Homo sapiens
cccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtacgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgcaccctgacattggcatctctgccaaggccatgagcatcatgaactcgtttgtaaacgacgtgtttgagcagctggcgtgtgaggctgcccggctggcccagtactcgggccggaccaccctgacatcccgagaagtccagacggctgtgcgtctgctgctgcctggggagctggccaagcacgctgtgtctgagggcaccaaggctgtcaccaagtacaccagctccaagtgacccagggcctgacaaaaataaagggtgaactgtt

SEQ ID NO: 3041 - DNA, 3546 bp, Homo sapiens
gagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtacgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttagacctgcgtgacatctacaaagcgcccaataaagaaagaggaagccacggtccctaccttccttctcgggtctctggggccttctcctccctgcagtgccaacatgcactgcccacagcaggagctggatccagcgtcagtgtgtcgatgggaactgaagactagtccataggagctggaagaactttgtccctttacttctgatttgaaattgtaccttttctcaggcctgtgattcacagactttaacatgaatcagaatcacctggagggctcatgcaatcagattgccagatctcgcctcagcgtttctggttcaataggttttgggggagaccaagaacgttaacatttctagcaagtttccaggtgatgctgttgttgctggtctagagactattttgagaaccactgtccaggagcgtggttttctgattgtgatctgaggttctgccccaactgcacagcagttgggctgcttgttaaaaatgcaggccaggtgcggtggctcacacctgtaatcccagcgctttgggaggctgaggcaggtggatcacttgagctcaggagttcaagaccagcttgggaaacatggcaaaacccgtctttatgtgcctggaatcccacctgctcaggtggctagggtggatggatcgcttgagcccaggaggtggaggttgcagtgagctgagattgcaccactgcattccagcctggatgacagagcaaaaccctgtctcaaaaaaatgcagactggccaggcacagtggctcacacctgtaatccgactgtaagctcatcaccttgggaggccactgtaggaggatcaattgagcctagaagttcaagaccagcctgggcaaagtagggagaccccttctctacaaatagtaataaaatgaaccgggcatagtagcatgtgcctgcggtcccagctgctctgataagaggaggctcacttgagcccaggaggttgaggctgcagtgagcagagcgtgccgctacactccagcctgatgacagaccgagacactgtctcaaaaaaataaaaaaattcagattgctga

SEQ ID NO: 3042 - DNA, 941 bp, Homo sapiens
gagaagctgacgggcggggtgggggaggacccgggggtgacgagcgtggagactcggaggggactcacgcgggcgaggacgagtgcgtcccggcaagaggctgggctcgacggccgggtgatgtggagagggacgatcgagaagaggcccgagacggacgggaggaggaagcccggaaagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgcc

SEQ ID NO: 3043 - DNA, 1031 bp, Homo sapiens
gcgggggcaggccagggcatcagaggcttgatgttgatacgaagattcctgagagggatggagcagggcccaggcattcttactagtaagtttagggtttgggggtatctgtttgccttccttcaggctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttct

SEQ ID NO: 3044 - DNA, 3211 bp, Homo sapiens
atggtcaggagaggttggtctgtctgtaccgccattctcttggccagactgtggtgtctggtccctactcacaccttcctgtcagagtatccagaggccgcagagtatccacaccctggctgggtgtactggctacagatggctgtggctccaggtcacctgcgtgcctgggtgatgagaaataatgtcacaacaaatatcccatctgcattctctgggacactgacccatgaagagaaagcagttctcacagtttttacaggcacagccacagccgtgcatgtacaggtggcagctttagcttctgctaaactggagagctcagtgtttgtgacagactgcgtgtcctgcaaaatcgaaaatgtctgtgattcagctcttcagggaaaaagggtgccgatgtctggcctacagggctcaagcattgtcatcatgcccccatccaaccgtccactcaaggccagtgcggcatcctgcacgtggtcagtccaagtccagggagggccccatcacctgggggtggtcgctatcagtggcaaagtcttgtcagcagctcatggggcaggaagggcctatggttgggggtttcctggcgatcccatggaggaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcct

SEQ ID NO: 3045 - DNA, 3037 bp, Homo sapiens
agcctgcgactgcactcccggggacaccctctcccggacccactcggggaggcggcggcgaaggcccggggagacccgcgaggggcaagcccggattcctgccggccgcctttctgcgcgcgccggagagagagacgcggtggggacagggatgcgcatttcacttccccgagctccggagagggatggcggggtgtcggcgagttcactgctggacacagttactaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 3046 - DNA, 2923 bp, Homo sapiens
gctttataaaggggagtttccctgcacaagctctctctcttgtctgccgccatgtgagacatgcctttcaccttccgccatgatcatgaggcttccccagccacatggaactaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 3047 - DNA, 3034 bp, Homo sapiens
gagccggagccggatcccagccggagcccaagcgcagcccgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 3048 - DNA, 3475 bp, Homo sapiens
ttctttccaagggtctctgggtgaggcccgtgaccttcccaagcctctccctgtcttgtgaaacctgggcgtgatatacctcccttttagggctgctgcgatcatttaggcagattaaacctcataagtggtttcccatacaagaaagatgctagcagtgcaacagacagaacacttacctgcctgccctcccgccaggaggtggtcttccaacttttgcccggagtctacagagggtgggccctctctgctggggctccgggacatggtcaggagaggttggtctgtctgtaccgccattctcttggccagactgtggtgtctggtccctactcacaccttcctgtcagagtatccagaggccgcagagtatccacaccctggctgggtgtactggctacagatggctgtggctccaggtcacctgcgtgcctgggtgatgagaaataatgtcacaacaaatatcccatctgcattctctgggacactgacccatgaagagaaagcagttctcacagtttttacaggcacagccacagccgtgcatgtacaggtggcagctttagcttctgctaaactggagagctcagtgtttgtgacagactgcgtgtcctgcaaaatcgaaaatgtctgtgattcagctcttcagggaaaaagggtgccgatgtctggcctacagggctcaagcattgtcatcatgcccccatccaaccgtccactcgccagtgcggcatcctgcacgtggtcagtccaagtccagggagggccccatcacctgggggtggtcgctatcagtggcaaagtcttgtcagcagctcatggggcaggaagggcctatggttgggggtttcctggcgatcccatggaggaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 3049 - DNA, 2998 bp, Homo sapiens
gagccggagccggatcccagccggagcccaagcgcagcccgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 3050 - DNA, 3119 bp, Homo sapiens
agacactgaatcatcatttgtagtttggggggctttacatgcctgcagtggtgaaaactgaaattttgtcccacttaagggagtttcttcttccctttattaattgcaaaataaatatatgtcacttcagagggcagcagctggactacctatgtttgtggcgctacaccaacctgaacttcgcttcctgagacctaagattcagccccgtgctcagcagacatcagggatcaccgactctgtgccaggagctgttcttgatgctgggaacgcaggggtggacaaaacagagaaagccctgccctcagaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 3051 - DNA, 3849 bp, Homo sapiens
aagaacggcgggaccggcgagcagtagctggtaggagagcgcagtcgccccgcgggctcggaggacacagcgtccgggaccaggctctgggaagcgggtgtgcacagcccagcagagtcagggcgcgaccccaaccgcctctcaccatccttgccgtctcctccgagccgagggccggccctcctgcctcgcctgccccgccccggccccgccccggcccgggccgccgggaccgggagccgggacgcgggtgccgcagcccgaggcaggtaaggggagccccggctctccgtccccggtccgtggcagcgctgagcatcccggccccgcaccggcccgggggcgcgtcaaggtcggcggcgtgatggcggagaaggcgctggaggccgtgggctgtggactagggccgggggctgtggccatggccgtgacgctggaggacggggcggaaccccctgtgctgaccacgcacctgaagaaggtggagaaccacatcactgaagcccagcgcttctcccacctacccaagcgctcagccgtggacatcgagttcgtggagctgtcctattccgtgcgggaggggccctgctggcgcaaaaggggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctgctgccgcacctcacggtgttggaagccatgatggtctctgctaacctgaagctgagtgagaagcaggaggtgaagaaggagctggtgacagagatcctgacggcactgggcctgatgtcgtgctcccacacgaggacagccctgctctctggcgggcagaggaagcgtctggccatcgccctggagctggtcaacaacccgcctgtcatgttctttgatgagcccaccagtggtctggatagcgcctcttgtttccaagtggtgtccctcatgaagtccctggcacaggggggccgtaccatcatctgcaccatccaccagcccagtgccaagctctttgagatgtttgacaagctctacatcctgagccagggtcagtgcatcttcaaaggcgtggtcaccaacctgatcccctatctaaagggactcggcttgcattgccccacctaccacaacccggctgacttcatcatcgaggtggcctctggcgagtatggagacctgaaccccatgttgttcagggctgtgcagaatgggctgtgcgctatggctgagaagaagagcagccctgagaagaacgaggtccctgccccatgccctccttgtcctccggaagtggatcccattgaaagccacacctttgccaccagcaccctcacacagttctgcatcctcttcaagaggaccttcctgtccatcctcagggacacggtcctgacccacctacggttcatgtcccacgtggttattggcgtgctcatcggcctcctctacctgcatattggcgacgatgccagcaaggtcttcaacaacaccggctgcctcttcttctccatgctgttcctcatgttcgccgccctcatgccaactgtgctcaccttccccttagagatggcggtcttcatgagggagcacctcaactactggtacagcctcaaagcgtattacctggccaagaccatggctgacgtgccctttcaggtggtgtgtccggtggtctactgcagcattgtgtactggatgacgggccagcccgctgagaccagccgcttcctgctcttctcagccctggccaccgccaccgccttggtggcccaatctttggggctgctgatcggagctgcttccaactccctacaggtggccacttttgtgggcccagttaccgccatccctgtcctcttgttctccggcttctttgtcagcttcaagaccatccccacttacctgcaatggagctcctatctctcctatgtcaggtatggctttgagggtgtgatcctgacgatctatggcatggagcgaggagacctgacatgtttagaggaacgctgcccgttccgggagccacagagcatcctccgagcgctggatgtggaggatgccaagctctacatggacttcctggtcttgggcatcttcttcctagccctgcggctgctggcctaccttgtgctgcgttaccgggtcaagtcagagagatagaggcttgccccagcctgtaccccagccctgcagcaggaagcccccagtcccagccctttgggactgttttaaccttatagacttgggcactggttcctggcggggctatcctctcctcccttggctcctccacaggctggctgtcggactgcgctcccagcctgggctctgggagtgggggctccagccctccccactatgcccaggagtcttcccaagttgatgcggtttgtagcttcctccctactctctccaacacctgcatgcaaagactactgggaggctgctgcctccttcctgcccatggcaccctcctctgctgtctgcctgggagccctaggctctctagggccccacttacaactgaccaaagtggccccctctgggggtccccaccacacaagtgtttgtaaactgggctgctataaggttggagttccagggctgggccctggtggagtccactggaagtcccattatggatgttgaaatggacagggaaggactctggaagtctcttcctcctcctcctcttctctccacccctagaccctggctgacttggacaatctgccaggacagaagctgggttttctgtctaggtcaccactcccaatcctggggattggagaggcctggggctgtgggatgccccatccccctccccatcacctttggtgggggcagggcctggtggcacctgtgcaataatgtctgtgtttctctcccacctgccactggaactggagaatgcactttattctgggcggggggtgagtgggggaagacccaaccctcctttctcgctgcccctaacgcatgcacggtctcgtgatgctccctccctctccggagtgacaggcacatacatgagaacaggccatctcagccctacacacttgccatcccctacagcacagaggaagagtgatggtggcatgctggtggtggcgggtgctggtgggaggacagtgccaacctcctcctggggatcccatgttggagactctaaggataaggctggtgctgcccagggtgtctacaggaactgcaggtgtctacccccaagtcttccctcctcccaagccaggggtggcacagggcactagatccctggagttcaggaaccaacacaagcacaaccacgggcataagttggccttggccactgccacccacggccctccttttgtgctccatgctggcatcttcactcccctaccccttccccagccactgctgctcattcaaacttctgtccatgtccctccactgttcctatcagcaggtggcccctgggcatcagaacagcctgccctgggcaccaggtggcagacacactcagagcatgtctggctttcctggtgggtccaggctcattctgcttctgatttcccctcccccagggctcattttccccctttttcctgtacacatccctgtctacctcctctcaccctgccacagattcttcctatcacacagggatgccagttgtatttgtgggatttcacccattattaataaaacctatatttatacag

SEQ ID NO: 3052 - DNA, 2458 bp, Homo sapiens
aagggatggggagtgggacgcagccggaggcctgaagcctcctcctctccgccttcccctggtccgccctgcactcaccctgctaccccgacctcctagagcgggcagcctctgccggctgcctcttctcccccgccccctattccttcagtccccaggggctgctggcctgcggggtcggcggcgtgatggcggagaaggcgctggaggccgtgggctgtggactagggccgggggctgtggccatggccgtgacgctggaggacggggcggaaccccctgtgctgaccacgcacctgaagaaggtggagaaccacatcactgaagcccagcgcttctcccacctacccaagcgctcagccgtggacatcgagttcgtggagctgtcctattccgtgcgggaggggccctgctggcgcaaaaggggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctgctgccgcacctcacggtgttggaagccatgatggtctctgctaacctgaagctgagtgagaagcaggaggtgaagaaggagctggtgacagagatcctgacggcactgggcctgatgtcgtgctcccacacgaggacagccctgctctctggcgggcagaggaagcgtctggccatcgccctggagctggtcaacaacccgcctgtcatgttctttgatgagcccaccagtggtctggatagcgcctcttgtttccaagtggtgtccctcatgaagtccctggcacaggggggccgtaccatcatctgcaccatccaccagcccagtgccaagctctttgagatgtttgacaagctctacatcctgagccagggtcagtgcatcttcaaaggcgtggtcaccaacctgatcccctatctaaagggactcggcttgcattgccccacctaccacaacccggctgacttcatcatcgaggtggcctctggcgagtatggagacctgaaccccatgttgttcagggctgtgcagaatgggctgtgcgctatggctgagaagaagagcagccctgagaagaacgaggtccctgccccatgccctccttgtcctccggaagtggatcccattgaaagccacacctttgccaccagcaccctcacacagttctgcatcctcttcaagaggaccttcctgtccatcctcagggacacggtcctgacccacctacggttcatgtcccacgtggttattggcgtgctcatcggcctcctctacctgcatattggcgacgatgccagcaaggtcttcaacaacaccggctgcctcttcttctccatgctgttcctcatgttcgccgccctcatgccaactgtgctcaccttccccttagagatggcggtcttcatgagggagcacctcaactactggtacagcctcaaagcgtattacctggccaagaccatggctgacgtgccctttcaggtggtgtgtccggtggtctactgcagcattgtgtactggatgacgggccagcccgctgagaccagccgcttcctgctcttctcagccctggccaccgccaccgccttggtggcccaatctttggggctgctgatcggagctgcttccaactccctacaggtggccacttttgtgggcccagttaccgccatccctgtcctcttgttctccggcttctttgtcagcttcaagaccatccccacttacctgcaatggagctcctatctctcctatgtcaggtatggctttgagggtgtgatcctgacgatctatggcatggagcgaggagacctgacatgtttagaggaacgctgcccgttccgggagccacagagcatcctccgagcgctggatgtggaggatgccaagctctacatggacttcctggtcttgggcatcttcttcctagccctgcggctgctggcctaccttgtgctgcgttaccgggtcaagtcagagagatagaggcttgccccagcctgtaccccagccctgcagcaggaagcccccagtcccagccctttgggactgttttaaccttatagacttgggcactggttcctggcggggctatcctctcctcccttggctcctccacaggctggctgtcggactgcgctcccagcctgggctctgggagtgggggctccagccctccccactatgcccaggagtcttcccaagttgatgcggtttgtagcttcctccctactctctccaacacctgcatgcaaagactactgggaggctgctgcctccttcctgcccatggcaccctcctctgctgtctgcct

SEQ ID NO: 3053 - DNA, 2552 bp, Homo sapiens
ggagctttgagccgggctcggtggtctgccccaaactgagcaggccctccccttgcaggtcggcggcgtgatggcggagaaggcgctggaggccgtgggctgtggactagggccgggggctgtggccatggccgtgacgctggaggacggggcggaaccccctgtgctgaccacgcacctgaagaaggtggagaaccacatcactgaagcccagcgcttctcccacctacccaagcgctcagccgtggacatcgagttcgtggagctgtcctattccgtgcgggaggggccctgctggcgcaaaaggggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctgctgccgcacctcacggtgttggaagccatgatggtctctgctaacctgaagctgagtgagaagcaggaggtgaagaaggagctggtgacagagatcctgacggcactgggcctgatgtcgtgctcccacacgaggacagccctgctctctggcgggcagaggaagcgtctggccatcgccctggagctggtcaacaacccgcctgtcatgttctttgatgagcccaccagtggtctggatagcgcctcttgtttccaagtggtgtccctcatgaagtccctggcacaggggggccgtaccatcatctgcaccatccaccagcccagtgccaagctctttgagatgtttgacaagctctacatcctgagccagggtcagtgcatcttcaaaggcgtggtcaccaacctgatcccctatctaaagggactcggcttgcattgccccacctaccacaacccggctgacttcatcatcgaggtggcctctggcgagtatggagacctgaaccccatgttgttcagggctgtgcagaatgggctgtgcgctatggctgagaagaagagcagccctgagaagaacgaggtccctgccccatgccctccttgtcctccggaagtggatcccattgaaagccacacctttgccaccagcaccctcacacagttctgcatcctcttcaagaggaccttcctgtccatcctcagggacacggtcctgacccacctacggttcatgtcccacgtggttattggcgtgctcatcggcctcctctacctgcatattggcgacgatgccagcaaggtcttcaacaacaccggctgcctcttcttctccatgctgttcctcatgttcgccgccctcatgccaactgtgctcaccttccccttagagatggcggtcttcatgagggagcacctcaactactggtacagcctcaaagcgtattacctggccaagaccatggctgacgtgccctttcaggtggtgtgtccggtggtctactgcagcattgtgtactggatgacgggccagcccgctgagaccagccgcttcctgctcttctcagccctggccaccgccaccgccttggtggcccaatctttggggctgctgatcggagctgcttccaactccctacaggtggccacttttgtgggcccagttaccgccatccctgtcctcttgttctccggcttctttgtcagcttcaagaccatccccacttacctgcaatggagctcctatctctcctatgtcaggtatggctttgagggtgtgatcctgacgatctatggcatggagcgaggagacctgacatgtttagaggaacgctgcccgttccgggagccacagagcatcctccgagcgctggatgtggaggatgccaagctctacatggacttcctggtcttgggcatcttcttcctagccctgcggctgctggcctaccttgtgctgcgttaccgggtcaagtcagagagatagaggcttgccccagcctgtaccccagccctgcagcaggaagcccccagtcccagccctttgggactgttttaaccttatagacttgggcactggttcctggcggggctatcctctcctcccttggctcctccacaggctggctgtcggactgcgctcccagcctgggctctgggagtgggggctccagccctccccactatgcccaggagtcttcccaagttgatgcggtttgtagcttcctccctactctctccaacacctgcatgcaaagactactgggaggctgctgcctccttcctgcccatggcaccctcctctgctgtctgcctgggagccctaggctctctagggccccacttacaactgaccaaagtggccccctctgggggtccccaccacacaagtgtttgtaaactgggctgctataaggttggagttccagggctgggccctggtggagtccactggaagtcccattatggatgttgaaatggacagggaaggactctggaagtctcttcctcctcctcctcttctctcc

SEQ ID NO: 3054 - DNA, 2740 bp, Homo sapiens
aagtcccagtcctgctgtcccaagggactccggggtcaggtggagcaggcagggcagtctgccacgggctccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaaggtggaggccgtcatggcagagctgagtctgagccatgtggcagaccgactgattggcaactacagcttggggggcatttccacgggtgagcggcgccgggtctccatcgcagcccagctgctccaggatcctaaggtcatgctgtttgatgagccaaccacaggcctggactgcatgactgctaatcagattgtcgtcctcctggtggaactggctcgcaggaaccgaattgtggttctcaccattcaccagccccgttctgagctttttcagctctttgacaaaattgccatcctgagcttcggagagctgattttctgtggcacgccagcggaaatgcttgatttcttcaatgactgcggttacccttgtcctgaacattcaaacccttttgacttctatatggacctgacgtcagtggatacccaaagcaaggaacgggaaatagaaacctccaagagagtccagatgatagaatctgcctacaagaaatcagcaatttgtcataaaactttgaagaatattgaaagaatgaaacacctgaaaacgttaccaatggttcctttcaaaaccaaagattctcctggagttttctctaaactgggtgttctcctgaggagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggcagatggatggtgagcaccactgctacagagcacccagtgattttactgaggattaaaataaaaaaccgtaggaatgggctcaacagtga

SEQ ID NO: 3055 - DNA, 2896 bp, Homo sapiens
gctccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcaggtaaggcagagcccttgctgctgctgctcccccaggagtgcggggcccggcgctcacccctctgctgcctttcttcactctttaagtgccagtctgggcacttcgggctccctctttagtggatcgggtggagagaggagagggagaagggctgtgctgggaaacatggagcgacagtgaatggcccctccccctgcccagggaagggcctgggcataaacaaagtggcagcagtgccctgccaacccagtgtctacggcctgccctctgtggatgggaatgggggtactgcgaatgcaaggagtcttgaaacctggtgaaagaatgcagggacagccacctcgcagccaaacggacaggacattcagagcaactccagcacaggccccctccctacgtggcagacagcctcagtcgctatctgccaggttctacagaggagggcgcagagactgaaacacgttaggagcctgtccggagactactggggtggggcacaggtaggatcaatgctggggacctgggtgtggccccttccagggccccaagctgcctttgccttcctggggtttcctttaaagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaaggtggaggccgtcatggcagagctgagtctgagccatgtggcagaccgactgattggcaactacagcttggggggcatttccacgggtgagcggcgccgggtctccatcgcagcccagctgctccaggatcctatggacctgacgtcagtggatacccaaagcaaggaacgggaaatagaaacctccaagagagtccagatgatagaatctgcctacaagaaatcagcaatttgtcataaaactttgaagaatattgaaagaatgaaacacctgaaaacgttaccaatggttcctttcaaaaccaaagattctcctggagttttctctaaactgggtgttctcctgaggagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggca

SEQ ID NO: 3056 - DNA, 3033 bp, Homo sapiens
tccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcaggtaaggcagagcccttgctgctgctgctcccccaggagtgcggggcccggcgctcacccctctgctgcctttcttcactctttaagtgccagtctgggcacttcgggctccctctttagtggatcgggtggagagaggagagggagaagggctgtgctgggaaacatggagcgacagtgaatggcccctccccctgcccagggaagggcctgggcataaacaaagtggcagcagtgccctgccaacccagtgtctacggcctgccctctgtggatgggaatgggggtactgcgaatgcaaggagtcttgaaacctggtgaaagaatgcagggacagccacctcgcagccaaacggacaggacattcagagcaactccagcacaggccccctccctacgtggcagacagcctcagtcgctatctgccaggttctacagaggagggcgcagagactgaaacacgttaggagcctgtccggagactactggggtggggcacaggtaggatcaatgctggggacctgggtgtggccccttccagggccccaagctgcctttgccttcctggggtttcctttaaagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaagagacagggtctctctttgttgcccaagctggtctcaaactcctggcctcaagcaattctccctcctcagccttccaaagtattgggattacaggcatgagccactgcacccagcctctggggacgttttaaaaaattcatattatttatttaaatctgacacatgtattacgatttaagccgaattggatcatattattatcaaagacatgctttccccagggtgtggtgagtctggaagtggcccttggattcttgggcggtgtgctgcctctttcatgtcctccccagcccatgaattgaaatagcagccacagagactcccagccttcctgtaatttgtgtctcctgcaggtggaggccgtcatggcagagctgagtctgagccatgtggcagaccgactgattggcaactacagcttggggggcatttccacgggtgagcggcgccgggtctccatcgcagcccagctgctccaggatcctagagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggca

SEQ ID NO: 3057 - DNA, 2665 bp, Homo sapiens
ctccaggaaacagagtgaagacactggccctggcaggcagcagctgggtctaagagagctgcagcccagggtcacagacctgtgggccccatggccgggaaggcggcagaggagagagggctgccgaaaggggccactccccaggatacctcgggcctccaggatagattgttctcctctgaaagtgacaacagcctgtacttcacctacagtggccagcccaacaccctggaggtcagagacctcaactaccaggtggacctggcctctcaggtcccttggtttgagcagctggctcagttcaagatgccctggacatctcccagctgccagaattcttgtgagctgggcatccagaacctaagcttcaaagtgagaagtgggcagatgctggccatcatagggagctcaggttgtgggagagcctccttgctagatgtgatcactggccgaggtcacggcggcaagatcaagtcaggccagatctggatcaatgggcagcccagctcgcctcagctggtgaggaagtgtgtggcccacgtgcgccagcacaaccagctgctccccaacttgactgtgcgagagaccttggccttcattgcccagatgcggctgcccagaaccttctcccaggcccagcgtgacaaaagggtggaggacgtgatcgcggagctgcggcttaggcagtgcgctgacacccgcgtgggcaacatgtacgtgcgggggttgtcggggggtgagcgcaggagagtcagcattggggtgcagctcctgtggaacccaggaatccttattctcgacgaacccacctctgggctcgacagcttcacagcccacaacctggtgaagaccttgtccaggctggccaaaggcaaccggctggtgctcatctccctccaccagcctcgctctgacatcttcaggctgtttgatctggtcctcctgatgacgtctggcacccccatctacttaggggcggcccagcacatggtccagtatttcacagccatcggctacccctgtcctcgctacagcaatcctgctgacttctatgtggacctgaccagcattgacaggcgcagcagagagcaggaattggccaccagggagaaggctcagtcactcgcagccctgtttctagaaaaagtgcgtgacttagatgactttctatggaaagcagagacgaaggatcttgacgaggacacctgtgtggaaagcagcgtgaccccactagacaccaactgcctcccgagtcctacgaagatgcctggggcggtgcagcagtttacgacgctgatccgtcgtcagatttccaacgacttccgagacctgcccaccctcctcatccatggggcggaggcctgtctgatgtcaatgaccatcggcttcctctattttggccatgggagcatccagctctccttcatggatacagccgccctcttgttcatgatcggtgctctcatccctttcaacgtcattctggatgtcatctccaaatgttactcagagagggcaatgctttactatgaactggaagacgggctgtacaccactggtccatatttctttgccaagatcctcggggagcttccggagcactgtgcctacatcatcatctacgggatgcccacctactggctggccaacctgaggccaggcctccagcccttcctgctgcacttcctgctggtgtggctggtggtcttctgttgcaggattatggccctggccgccgcggccctgctccccaccttccacatggcctccttcttcagcaatgccctctacaactccttctacctcgccgggggcttcatgataaacttgagcagcctgtggacagtgcccgcgtggatttccaaagtgtccttcctgcggtggtgttttgaagggctgatgaagattcagttcagcagaagaacttataaaatgcctctcgggaacctcaccatcgcggtctcaggagataaaatcctcagtgtcatggagctggactcgtaccctctctacgccatctacctcatcgtcattggcctcagcggtggcttcatggtcctgtactacgtgtccttaaggttcatcaaacagaaaccaagtcaagactggtgattcacgccagacgtctgcccgctggtgggggacctgagcagacccttcaactgcactccctcctcaggagccccttcctggggacagtgaggacaatgaccctacagatgctcagctacatccggcccagggtgctgcagtggcacagaccagccacaggatggcagtagaataaagacagtcgaaagggatttctgctcactggcaggagactgcgatgactgggagaaaacctgcactcggtggcacctacaacgttgctaatttatttccttttgatatgcatttatataggcaactcgatataggatgggagcaaactaggaatgaattgggtagctagactgtgcaggaattgttggaacctggagggaacaataacagtagctagcagatttggcttcatcttccaggggccccacactccgtggtgagccaccatcaatacagaaagtgacctaagatgtaccagcaagatgccatcccttctttttgtgtggggtcatgggctccaaaagccaacgtgaacaattaaaaatgtattgagcatcta

SEQ ID NO: 3058 - DNA, 2590 bp, Homo sapiens
gggcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 3059 - DNA, 2509 bp, Homo sapiens
gggcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 3060 - DNA, 2376 bp, Homo sapiens
actcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagctttgcaagaaagcagacacttcatatcaccatctgtaggtccctaagaaaaccaggaatatgtggaattttagttgtgcaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 3061 - DNA, 2721 bp, Homo sapiens
gtgagtgctcctcgcggccttttgctcggagggagttgtcaaccgcgccagatccccttgatggctgtggcttcggaacctcgcggccagcactgccttttcgcctttttaaaatatgggaacaccctgatttaagcagcggttgtcttccagaaggtcctttgattttagggggaaatgcattagccaggtcaaacagccgatttgaaacacagaaggctaagttgacattttacgttattttctaaagtttaggccacttggttcttggttctaagcagagatccttggaacacacctaccaccaccatcagaaccatcactacccatgcatggggacccattcttgtgacaagtttgagcggctttagatcttatgaagcccactgtctcccttgggcagtgtgagcatgggaggagccagacacaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccgg

SEQ ID NO: 3062 - DNA, 711 bp, Homo sapiens
gattggcccctgggccaggggcggggcactcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaac

SEQ ID NO: 3063 - DNA, 2376 bp, Homo sapiens; identical to SEQ ID NO: 3060

SEQ ID NO: 3064 - DNA, 2867 bp, Homo sapiens
ggtttccttattcatcctctagtagtagctctgcagcagcctcctcttccagttcttcctcctcttcctctgcctccccccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccagg

SEQ ID NO: 3065 - DNA, 4293 bp, Homo sapiens
gacgccatactggacgccaagtgggaggaacttcaaggctgtcccctgcgggcctcccgctctgcttctgcgaaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctctt

SEQ ID NO: 3066 - DNA, 4290 bp, Homo sapiens
ccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctctt

SEQ ID NO: 3067 - DNA, 4279 bp, Homo sapiens
caggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaa

SEQ ID NO: 3068 - DNA, 1330 bp, Homo sapiens
tgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatca

SEQ ID NO: 3069 - DNA, 8479 bp, Homo sapiens
ggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacatagcttgtgatgaatggaaaatactaccaaaaccaaatcttcatagagatgtcaacagatttggacactctgcagtagtcattaacgggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacagctgcttctgatgacagatgttacagatatgcagattgtgccagctgtactgccaatacaaatgggtgccaatggtgtgatgacaagaaatgcatttcggcaaatagtaactgcagtatgtctgtcaagaactacaccaaatgtcatgtgagaaatgagcagatttgtaacaaacttaccagctgtaaaagctgttcactaaacttgaattgccagtgggatcagagacagcaagaatgccaggctttaccagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattacagccttttgattgattatcaatttaccttcagcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaagattgtgtaaaagttcaagcccgttttagaaagccaacattttatgttataatatgctgttaatcaggactttattaaataaaaacattggctcttccaacccccac

SEQ ID NO: 3070 - DNA, 1646 bp, Homo sapiens
ctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattacagccttttgattgattatcaatttaccttcagcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctgg

SEQ ID NO: 3071 - DNA, 488 bp, Homo sapiens
gcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgg

SEQ ID NO: 3072 - DNA, 591 bp, Homo sapiens
ctctagtgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggtgggtaaggccccagcacttgctgaacaaacctacagctcacacctctcatcagagcgaacaccttggcctttgagagcttgagtggagcgggagagccctctgggttcttttcaatccactgtccaccttctttggagtggttacaaatattttattattgtctaatgcaaatcacaagttcagggaattcttacagaccctgtgagtggacagagcactgtgtaatgtct

SEQ ID NO: 3073 - DNA, 749 bp, Homo sapiens
gcaaaaccgaaggcgcttctgcgacgcgcggaccgcaagactccaatcagactttagtgctgcccccaccctaaacgaaagcctccttctggtccgaaccgactggatcccttggccaggggaggaaaaggccgggtgaccacgggcccggcccgcagaaaggaggcggcgcggccggcagggatcaggactggagggggcggagcctccctcgcggccgggcccggagtgggaggggcctccgggaccaggcctctagtgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagcttccctgcaataaaatcaagctgcttttgttgga

SEQ ID NO: 3074 - DNA, 1490 bp, Homo sapiens
aggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatgggaa

SEQ ID NO: 3075 - DNA, 1577 bp, Homo sapiens
aggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatgggaa

SEQ ID NO: 3076 - DNA, 1076 bp, Homo sapiens
gacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggagtgacttcctccactgaagtcttgaatccctccaagtcatccatgaagattggaatcatcatcttccaaactcctgttaatattgatattctggcctcttcccatgaatcatgaatgttcttaaagggatctagaatggcagatcctttccagaaggttttcaatttaatttgcccagatccataagaggaatcactgtctatggcagctatagccttatgaaatgtggtttttgttttgttttgtttttttgagacggagtctcgctctgttgccaggttggagtgcagtggtgtgatctcggctcactgcaacccctgcctccccggttcaagggattctcctgcctcagcctcctgagtagctgggactacaggtgcacaccaccgtgcccagctaatttttgtattttttgt

SEQ ID NO: 3077 - DNA, 3598 bp, Homo sapiens
cttccgcgccggcaggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcgtacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttttttttttttactctttgaaagctttgttttgtggtagtccttttgggaagaatccagtattatccacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgatttttttttttaatttgttttgctgagagcatagctatttgtttttattgtaaaacaataataataataaaaagcaaactcta

SEQ ID NO: 3078 - DNA, 954 bp, Homo sapiens
atgagagacagcgcatgctggcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgcccggaacggaggcttcagaagcagcagacctcctagcgctcccttgccttcctcagctgcctcctgcgccctgtgcccgactgactggaggaggcctgtcccaattccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgaggtcgcctgcctgcagcaggcagcttctactcctgcctcatgcgtacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaagacccacgggctcatgcacccctcagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttag

SEQ ID NO: 3079 - DNA, 2257 bp, Homo sapiens
agacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggctctcaactgaaggccaagccccccaagaagccggagagcagcgcagagcagcagcgccttccactcgggaacgggattcagaccatgtcagcttcagtccagagagctgtggccatgtcctccggggacgtcccgggagcccgaggggccgtggaggggatcctcatccagcaggtgtttgagtcaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccggtggaggtgaggctaggctgggccagcagggcagcgttcccgcccctctggccctccccagtgacccccagctccaccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaa

SEQ ID NO: 3080 - DNA, 1427 bp, Homo sapiens
atgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccaaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaa

SEQ ID NO: 3081 - DNA, 1542 bp, Homo sapiens
agaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctg

SEQ ID NO: 3082 - DNA, 1509 bp, Homo sapiens
atgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccaaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaa

SEQ ID NO: 3083 - DNA, 1963 bp, Homo sapiens
tgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaaccattgcc

SEQ ID NO: 3084 - DNA, 5113 bp, Homo sapiens
aggggattaatgaagagccaccagactatctttatggagaatctagattgggaagttaagctaagaatgtgcatttttgaaaaagtttttatggtagaagagaatgtatatcagaggaaagaatgtagagaagaaagcaacattgtccactgggaattgataagttctgcgtagaatttagagttataaggactatctcattggctcctaatgaatgctaaataacaaatggaaattgctatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 3085 - DNA, 5302 bp, Homo sapiens
aggggattaatgaagagccaccagactatctttatggagaatctagattgggaagttaagctaagaatgtgcatttttgaaaaagtttttatggtagaagagaatgtatatcagaggaaagaatgtagagaagaaagcaacattgtccactgggaattgataagttctgcgtagaatttagagttataaggactatctcattggctcctaatgaatgctaaataacaaatggaaattgctatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagacggagtcttgctctgtcacctaggctggagtacagcggcgctatcttggctcactgcaagctccgcctcccaggttcatgccattctcctgcctcagcttcccaagtagctgggactacgggagcccaccaccacgcccggctaatttttgcatttttagtagagatggagtttcaccatgttagccaggctggtctcgaactcctgacctcaggtgatctgcccacctcggcctcccaaagtgctgggattacaggcgtgagccaccgcgcctggccgaggctgctggaatcttccctcatttcattatcccgttatgatggagcaggatccagagagcacccaatttacccagacccagcgagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 3086 - DNA, 5023 bp, Homo sapiens
aggggattaatgaagagccaccagactatctttatggagaatctagattgggaagttaagctaagaatgtgcatttttgaaaaagtttttatggtagaagagaatgtatatcagaggaaagaatgtagagaagaaagcaacattgtccactgggaattgataagttctgcgtagaatttagagttataaggactatctcattggctcctaatgaatgctaaataacaaatggaaattgctatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 3087 - DNA, 5206 bp, Homo sapiens
aggggattaatgaagagccaccagactatctttatggagaatctagattgggaagttaagctaagaatgtgcatttttgaaaaagtttttatggtagaagagaatgtatatcagaggaaagaatgtagagaagaaagcaacattgtccactgggaattgataagttctgcgtagaatttagagttataaggactatctcattggctcctaatgaatgctaaataacaaatggaaattgctatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 3088 - DNA, 5351 bp, Homo sapiens
aaatgaagggcccttaatcataagcaatttcctagttacacgacctcagtgctcccagaaggggattaatgaagagccaccagactatctttatggagaatctagattgggaagttaagctaagaatgtgcatttttgaaaaagtttttatggtagaagagaatgtatatcagaggaaagaatgtagagaagaaagcaacattgtccactgggaattgataagttctgcgtagaatttagagttataaggactatctcattggctcctaatgaatgctaaataacaaatggaaattgctatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccct

SEQ ID NO: 3089 - DNA, 522 bp, Homo sapiens
gagctgtttttcggcgctcggctgtggttccttgaacgattgcttgggcgttcctcctttgatgtctggggcgttcttgtattcggtgatcttttgcgccgtcttcttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcagtggagaagagaaagagaaaatgagtgagaaagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatggga

SEQ ID NO: 3090 - DNA, 4102 bp, Homo sapiens
attcggtgatcttttgcgccgtcttcttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtag

SEQ ID NO: 3091 - DNA, 5067 bp, Homo sapiens
tcttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 3092 - DNA, 4817 bp, Homo sapiens
gccgccttctcctgccggtcggtagaacggaccccttcctttattcctgtctcctctttctttttccctgtggctcagcccgttcgctggactgcaaaccgagctcccgtctgccttgcagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 3093 - DNA, 6982 bp, Homo sapiens
gtgtcaggtgacagcccggaagctgcggaagcggatgagggaagggcggccgtggccctgggggcggcgggagctgctttgcctccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacactgcaattagacaatgaaaagatattatcggactatgggacaacttttgttacagcatggaagaatactcacaactacagggtgtggaacagcaacaagcatccagcacttgcagaaataaatccaaaccatccatttcaaggccaatactcagtatcagacatgaagttaaggttctcacattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttctgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttttggggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggatatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatgctgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcggactttctattaacatttctagctaagagtttgactcttagtggtcactttactgactttccaacataaaacaagtatctcagaagatacaactttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaacgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcctacagttgga

SEQ ID NO: 3094 - DNA, 2179 bp, Homo sapiens
gctttgcctccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacactgcaattagttctgttcagaatagtgaacgtgaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttc

SEQ ID NO: 3095 - DNA, 1392 bp, Homo sapiens
atggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagtgtacccaagatgtcttacctcaggcaaatcacagcttcaagtttttgataacggataggagaatcacaccaagaccacttcgaagaaggctggtttctgctacactaacaaatatgcttcaagagaagagttgctggaaaaaacacatcaagtgtagaagacgtgttcaaaaatag

SEQ ID NO: 3096 - DNA, 4255 bp, Homo sapiens
cggctgtgattggcgcggcgggatcactggctccgcgagcctggcccgggggagtcggctggagccggctgcgctttgataaggtcctggcaactcagtaacagcccgagagccgggaaataaaaataacccctcagagcgatggatttcggggccgcccggcggccgaggcgcccgccgaaggccctgctgtaaaagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgttttgtttttttttttcctatgctgctctgttttgtcttaaaggtcttgagggttgaccatgttgcgtcatcatcaacattttgggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgatgttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttc

SEQ ID NO: 3097 - DNA, 2426 bp, Homo sapiens
ccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttgg

SEQ ID NO: 3098 - DNA, 483 bp, Homo sapiens
atgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagtcaatgacttttgtcatgacattttgttctacttatactgtaaattatgcattataaagagttcatttaaggaaaattacttggtacaataa

SEQ ID NO: 3099 - DNA, 3008 bp, Homo sapiens
cggggtctcggcggggcggtcgctttggagccgcaaagtttggctgtggcggcaaatgggcttgggcggctcctcggcgggtggcggtggtggccgtagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaactaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgcttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaa

SEQ ID NO: 3100 - DNA, 1875 bp, Homo sapiens
tagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatag

SEQ ID NO: 3101 - DNA, 1568 bp, Homo sapiens
aatgaccaatggagatgcggggcaaggggattcagcggatctagctgttaatgccactgatttgtggtgaccaatatggattttctttctgtcgtttgtttcaaggcactagaaggagacttttggtccactgtccaggggtctatggagactaatgtaaaagggggtgatcctattgcttgagactccggggaagtagcgggggatattactgagaaacacccatcctctgacatacttaccaaatttctcagagtcggttcagcagttcttctaagggaagaagggcaatatatcggagtccacaagcgagaaaaagagggagtcggagaaccgagactacagaaccagggtgacggaaaaccaggacggcgccaagccggagtcacgtgacccggcggccatgatagctaccgaggcggtagtgcgcgcagctcagggattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgt

SEQ ID NO: 3102 - DNA, 4736 bp, Homo sapiens
gggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcaaacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctactttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacg

SEQ ID NO: 3103 - DNA, 4709 bp, Homo sapiens
gggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcaaacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctactttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacg

SEQ ID NO: 3104 - DNA, 912 bp, Homo sapiens
acagacctgccccgccatgacccggctgacagtcctggccctgctggctggtctgctggcgtcctcgagggccggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggtttgtcaacgtgactgtgacccccgaggaccagtgtcgccccaacaacgtgtgcaccggtgtgctcacccgccgcggtggcatctgcaatggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctg

SEQ ID NO: 3105 - DNA, 1713 bp, Homo sapiens
ggcagaggggaaatggggcctggcccacgggagagctgaggcccacgtttggccaggacagggtggatggaggctggggcctccgcagggaagatggacaggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggtttgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgcccaggctggagtgtagtggcgtgatctcggcggctcactgcaacctccgcctcctgggttcaagcgattctcctgcctcagcctcctaagtagctgggattacaggcatgcgccaccacgcccggctaattttgtatttttagtagagacagggtttctccatgtgggtcaggctggtctcgaactcctgacctcatgatcgacccaccttggcctcccaaagtgttaggataacaggcatgagccaccgtgcctggctgagaaacagtagctatcaaacgccggctgtgagccacgtctgtgctgggggttggggacccagcaggcatggtagagccggtcactgagggactcaggcgtgtgattgccaggggaggggcacctggcccagcctggaggtgccaggaagctccagaaagcaactgatcccaaagtccactagcagttaaccagggcagagaaagagaagagccatgcaaaggccctggggctggatcaggacttgtaggttccaggggcagcaagaggcctctgcagttctggggtggcgtgggagccaggccctgggacgccctgacacagctgctgcctgcccagggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctg

SEQ ID NO: 3106 - DNA, 11073 bp, Homo sapiens
agttgcggcgtcctgtgagcgcggggatgctgggaggagggtgaaatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccaagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatca

SEQ ID NO: 3107 - DNA, 10885 bp, Homo sapiens
agttgcggcgtcctgtgagcgcggggatgctgggaggagggtgaaatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccaagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatcatt

SEQ ID NO: 3108 - DNA, 4427 bp, Homo sapiens
agttgcggcgtcctgtgagcgcggggatgctgggaggagggtgaaatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcaggtatgtatttttctgtcctttaaaagttttttgaatttttcagaggaaataaataattccatgattattttgtccttaagtccaacaacacttaaaaatctctaa

SEQ ID NO: 3109 - DNA, 2861 bp, Homo sapiens
aatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattttgtctctggggaaatggcggcagcattgagagaaactgtaagactagacacctcaccaaaggagatggtaccagcagagattaatactaaagaaatgcagtcagatttaaaagaaactggaagaagagcc

SEQ ID NO: 3110 - DNA, 7919 bp, Homo sapiens
agttgcggcgtcctgtgagcgcggggatgctgggaggagggtgaaatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccaagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcagtctcctttt

SEQ ID NO: 3111 - DNA, 5562 bp, Homo sapiens
tgacaagaaggaaattccaaaaggctaagccaaatttgggaagagcacacagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcagagacccttctgacttgtggaagcaaaaggaagcagtgctgacacccacaagaatttaaggaactgtaaaactagaatttgttcacatgtttcatttctatgtctcctgaagctgtccaatggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatc

SEQ ID NO: 3112 - DNA, 2606 bp, Homo sapiens
ctgccctggtgcacacagatggcacatggcagagcccaagccctctccatgagatctgcagcgtttgtccacacggcagggcaaattaccttgtagagtcagcatggaggtttgctaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgccacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcaggatctgaagagctatggtgaaacaccactgaagcattgccaaggatggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagcctttctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcgagctgt

SEQ ID NO: 3113 - DNA, 2351 bp, Homo sapiens
cacacagatggcacatggcagagcccaagccctctccatgagatctgcagcgtttgtccacacggcagggcaaattaccttgtagagtcagcatggaggtttgctaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgccacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcaggatctgaagagctatggtgaaacaccactgaagcattgccaaggatggggctggtaagtagcaaaaagccggacaaggaaaagccgatcaaagagaaggacaagggccaatggagccccctgaaggtcagcgcccaagacaaggacgccccgccactgccgcccctggttgtcttcaaccaccttactcctccaccgcccgatgaacacctggatgaagacaagcatttcgtggtggctctgtatgactacaccgctatgaatgatcgggacctgcagatgctgaagggggagaagctacaggtcctgaagggaactggagactggtggctggccaggtcactcgtcacaggaagagaaggctatgtgcccagtaactttgtggcccgagtggagagcctggaaatggaaaggtggttctttagatcacagggtcggaaggaggctgagaggcagcttcttgctccaatcaacaaggccggctcctttcttatcagagagagtgaaaccaacaaaggtgccttctccctgtctgtgaaggatgtcaccacccagggggagctgatcaagcactataagatccgctgcctggatgaagggggctactacatctccccccggatcaccttcccctcgctccaggccctggtgcagcactattctaagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggttactacaaaaacaacatgaaggtggccattaagacgctgaaggagggaaccatgtctccagaagcctttctgggtgaggccaacgtgatgaaggctctgcagcacgagcggctggtccgactctacgcagtggtcaccaaggagcccatctacattgtcaccgagtacatggccagaggatgcctgctggatttcctgaagacagatgaagggagcagattgtcactcccaaggctgattgacatgtcggcgcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggggccaagttccccatcaagtggacagccccggaagccatccacttcggggtcttcaccatcaaagcagacgtgtggtcgtttggagtcctcctgatggaagttgtcacttatgggcgggtgccatacccagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcga

SEQ ID NO: 3114 - DNA, 908 bp, Homo sapiens
cgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagagccta

SEQ ID NO: 3115 - DNA, 755 bp, Homo sapiens
gtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagtttgtgcctggtcgcctcctcagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggagcagaggaaaaactcttgtcagatgggaaaaatgctcatgacataatgtgacattaaaaggtgggaaacaagaggatata

SEQ ID NO: 3116 - DNA, 805 bp, Homo sapiens
acctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagcccagcctggctgatgctgcccttctgtccccagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagagccta

SEQ ID NO: 3117 - DNA, 733 bp, Homo sapiens
ctgcgcctgcgcatgccacacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagatgagaacgctgaggctgagattcccagatcaacctgggtctctctctgccccagcccagcctggctgatgctgcccttctgtccccagtgacccgt

SEQ ID NO: 3118 - DNA, 601 bp, Homo sapiens
ctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggagcagaggaaaaactcttgtcagatgggaaaaatgctcatgacataatgtgacattaaaaggtgggaaacaagagga

SEQ ID NO: 3119 - DNA, 899 bp, Homo sapiens
ccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagagcctactatcacagctccccggaaagctgtcttctctgtccatggcctcacctcacccagggcactggccttggtccacatcaaggggacctgaa

SEQ ID NO: 3120 - DNA, 928 bp, Homo sapiens
aacctcatccggccaatcacagctagtcccgtgagctcggggaactgcccggcctgagatgcccaggtctgggactgttaccttggctactggctcccgaagtccccttccgcccagggaattgtgtccgccatttgcttggtcccaggagctctgggaatgtgtcatccccggtagagggtgcccgtcacggccaaccacagagatcccggtcctccgggattctagagcgtccggccgaaccctccactgacttccggtggctgagcctctccgcagcttccggccaagttggactgcagctcgcggtttcctggcttctagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagccaccttcagggctgtctgtcaaagatagcagtgtttcaagatgaaagcggcttgagtccctgagtcactgacttctgtgagaaacttccgcgggaagccgctgagacctggagatgtgttactgcagcgtaaccaagagcatcccacacacccttctttctctcctgtcccctgcactgaacgggcaccccctg

SEQ ID NO: 3121 - DNA, 1031 bp, Homo sapiens
aggggaggagcctgctgttgccccagcaacaaccacggaaaccaagacgagcgcggtcgcggaagtatcgcggcttacatatctcgcagccaggcgggtcctgggagaggcgcgagccaggcctggtcggcgcccgcggagaaaagaagcagtcaagcccatgaactacaaccccggttgccgctttctcctctcctaaccgttaagtgcgctaagggccatggctgaggtgcacgtgatcgggcagatcataggggccagcggtttctcggaaagtagcctcttctgcaagtggggcattcacacaggggcggcatggaagctcctgtcaggcgtgcgggagggccaaacgcaagtggacaccccgcagataggggacatggcttactggtcccaccccatcgacctgcacttcgccaccaaaggtcttcaaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacgtcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttacagg

SEQ ID NO: 3122 - DNA, 1368 bp, Homo sapiens
gaccccagaggccaccctggccacttccagaaagctgtgggccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggccatcaggacaaggtgaggtgcttcttctgctatgggggcctgcagagctggaagcgcggggacgacccctggacggagcatgccaagtggttccccagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggaggggtcagtccagccgaggcccagagggcgtggtgggttcttgagcccccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagcagcctg

SEQ ID NO: 3123 - DNA, 1302 bp, Homo sapiens
gaccccagaggccaccctggccacttccagaaagctgtgggccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggccatcaggacaaggtgaggtgcttcttctgctatgggggcctgcagagctggaagcgcggggacgacccctggacggagcatgccaagtggttccccagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggta

SEQ ID NO: 3124 - DNA, 4531 bp, Homo sapiens
ttcgactggaatgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctca

SEQ ID NO: 3125 - DNA, 4574 bp, Homo sapiens
gcgcgcgcggctgggagcggtagctgtgcctcggcgtccccgagctggtgccgagcgcagcgccccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggcctggggctctccctgccgtcagagccctcaccctgggccccacacacaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctca

SEQ ID NO: 3126 - DNA, 4581 bp, Homo sapiens
ttcgactggaatgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggcctggggctctccctgccgtcagagccctcaccctgggccccacacacaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctc

SEQ ID NO: 3127 - DNA, 3875 bp, Homo sapiens
actggcttcgggggacagcagggggagcagcctcttccacccagcaagggaggggaagggggcttgtgactcccaggcccctgaggatttcacgactggctgtgggggtgacagcttccagaagcactgtacccagcctaccaagcccccccatcttttgggggggaggctcacaggggaaggcactgataggtttgaaggaggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccggagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggc

SEQ ID NO: 3128 - DNA, 3886 bp, Homo sapiens
agtcgtcggcgcgcgcggctgggagcggtagctgtgcctcggcgtccccgagctggtgccgagcgcagcgccccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggct

SEQ ID NO: 3129 - DNA, 4528 bp, Homo sapiens
ttcgactggaatgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgcccccgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctc

SEQ ID NO: 3130 - DNA, 3423 bp, Homo sapiens
attgggcgttacgcgagggcggggccggttgccaggacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatggagttaatgagttgc

SEQ ID NO: 3131 - DNA, 1002 bp, Homo sapiens
ggttgccaggacgacgcctgcgaagatggccgctgcgtcctcatcggattccgacgcctgcggagctgagagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagatgatcatacaagccaccatagtgaaggtgggcggaagacaagacaccatagtgaaggtgggaggaagacaagacaccatagtgaaggtgggaggaagacacacttgatgttttccaaggccacacatttactaaggtggcagaagtggaaataatcccagggtcatctgctttggggccagtgttcctcccagagactccaagcaccccaagtactgcatcgagctga

SEQ ID NO: 3132 - DNA, 3595 bp, Homo sapiens
attccgtttccggccgttcccacccctgttttcggtcggcccgggtgttctgcaagctggtcaaaaaggggaagcggcccagatatgttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggatgatagtggactgtgtttccagtcatctcaaaaaaacaggagatggtgcaaaaacatttattatctttctttgccatttgcttagaggacttcatgcaatcacagacagagaaaaggatcctttgatgtgtgaaaacattcaaacccatggaaggcattggaaaaattgttctcggtggaaatttatttcccaggctctcctaacgtttcagacacaaatattagacggtattatggaccagtacctaagtagacactttttgtctatcttttcgtctgctaaagagagaacattgtgtaggagctctttagagttgctcttagaagcatacttttgtggaagagtgggaagaaataatcataaatttatttcacagttgatgtgtgactactttttcaagtgtatgacttgtaaaagtgggattggtgtatttgagttagtggatgaccattttgtagagttgaatgttggtgtcactggccttcctgtttcagattccaggatcatagctggtcttgtgcttcagaaagatttttctgtgtaccgcccagcagatggtgacatgcgaatggtgatagtaacagaaaccattcagcctcttttttccacttctggatcagagtttattctaaattcagaagcacagtttcagacatctcaattttggattatggaaaagacaaaagcaataatgaaacatctacatagtcagaatgtaaaattgctcatatctagtgtgaaacaaccagatttagttagttattatgcaggggtgaatggcatatcagtggttgagtgtttatcatcagaagaagtttctcttatccggaggatcattggtctttctccatttgtaccaccacaggccttttcgcagtgtgaaatacctaacactgctttggtgaaattttgtaaacctcttatccttagatccaaaagatatgttcatctaggcttgataagcacatgtgcatttataccacactctatagttctttgtggaccagtgcatggtctcattgaacaacatgaggatgctttacatggagcacttaaaatgcttcggcaattatttaaagaccttgatctaaattacatgacacaaaccaatgaccaaaatggcacttcaagtctttttatttataagaacagtggagaaagttatcaagcaccagatcctggtaatggctcaatacaaaggccttatcaggacacagttgcagagaacaaagatgcattggaaaaaactcaaacatatttaaaagtacattctaatttggtaattccagatgtagaattagaaacatatattccgtattcaacccccacactgacaccaacagatacattccaaacagttgaaacgctgacatgtttgtctttggaaagaaacaggctaactgattattatgaaccattactcaagaacaattccactgcttattcaacaaggggaaatagaatagaaatttcttacgaaaatttacaggtcacaaatattactagaaagggaagcatgttaccagtgagctgtaagttaccgaatatgggtacttcccagagttacctttcctcatctatgccagctggttgtgttttgccagtaggtggtaattttgagatcttgttacattactatcttctcaattatgccaaaaaatgccatcaatcagaagaaaccatggttagtatgataatagctaatgcacttttaggcattcccaaagtcctttataaatctaaaacaggaaagtacagctttccacatacatatataagagctgtccatgcactgcaaaccaatcaacccttggtaagcagtcagacaggtttggaatcagtaatgggtaaataccagctactaacttcagttcttcagtgtttgacaaaaatattaaccattgacatggtaatcactgttaagagacaccctcagaaagttcacaatcaagattcagaagatgaactataacatcagaagtttttaattaaccaaacttttcatctaactcaagccaagtaaagcagtcatgtgaccactggttctaaagtcagttcagtctacttaggaaaatagcgtaactttaaaagtctttagaagaagcacactaaggtcaccagaccagatacaaatattaaattactttatggaacaaatctagaggggaagccaagatttggctaagtgtgtctgttttttccctattttatgcctctgtgtctcagctctgtgttagcctatgtgtttaggggagggtttttctttatagctcctttttactctcctgtatctttttcactccagccctccttcatcgttacatgtttagttcatagaatcatttaatctctgatttgggtgggcttattctaattgtttttaatattgaatacattatttgcattaattttccctactcatactttgtaaagctgagtaaaaggctcaaattatttttttcaaaaagcataaaattaaattagcagtgagtaaaaggctcaaattttttttcaaaaagcataaaattaatttttacttttatgtggtcattggtttactgccacttcatttggaaaacttggatagattttcacctttgatatacctttgaatatatgttacctgaaatataactgtgcattgttaactctttcatttctgtagtaaaaggttaatactagaaaggatatgcaattaatactttgattttctcctgaccccaagagcttgtaaggatatgtcatgtatttactggtttttcttgtatctggtgcatagccagagttccacagtaacaaataatttgacaatttttatttctaatgtttatttctgttttatttttaatttttatttctaatttatttcatttacaaatgttcatattttaaaaacttgtcaatgtaaataatatgatgcatcttatcatggacaaggacagtgttttctacctttatcagttctctgtaatacccaaaacagtgctgtatttactccaagtattcagaagtgcttgttgaacaaaacagtgttatctttaattcattcctttaaatacatgtttccagtttacttattcaacagattcttacttgggattgactgaagaaaaaaaactttaattatagttgaataagtgttgactaatgtattttaaaaactataatatcaaaattttttatattaaatgtaattctgattttttaaacatttatgctatatgatgcattattttgtttctgtgaatatggagagaataaattagctcttttgctgaattcatggatgaatgaactttaaaactgctgca

SEQ ID NO: 3133 - DNA, 3244 bp, Homo sapiens
gtctcttagcaactaagcccccggctcctccagaagcccctcttcgcacatgcgcaaactgcggacggggaactgggctccctagccctggcgtttttggtgttgctgtcccagccagaatcgcgtctggccggtgggaagccgggaactccagccccctgtaggagaggagaaaggagcgagatcatgatacatggtgatggcttgcagagtcgtaaacaaaagaagacacatgggacttcaacaactttcatcattcgcggaaacaggaagaactttcctaggcccactaaaatcatccaaatttattatagatgaagaatgtcatgaaagtgtattaatcagttcaacagtaaggcttcttgaaagtttggatttaaccagtgcagtgggacaacttctcaatgaagcagttcaagcacaaaacaacacatatagaactggaatcagtactcttttgtttcttgttggtgcttggagcagtgcagttgaagaatgtcttcatcttggtgtccccatttccataatagtatcagtaatgtcagaaggcttaaacttttgtagtgaagaggtagtttctcttcatgtacctgttcacaatatatttgactgtatggacagcacaaaaacattttctcaacttgaaacatttagtgtaagtttgtgtccttttctacaggtcccttcagatactgatttgatagaggaattgcatggtctcaaagatgttgcctctcaaacactgaccatttccaacctttctgggagacctcttaaatcatatgaattatttaaacctcagacaaaggttgaagcagataacaacacatcacgaactctgaaaaacagcctgcttgcagatacctgctgcagacagtcaatactaatccacagtaggcattttaataggacagataatactgaaggggtaagcaaaccagatggatttcaagaacatgttacagctactcacaaaacttacagatgtaatgatttggtagagttggcagtaggcttgagtcatggagatcacagcagcatgaagttagtagaagaagcagtacagctgcaatatcagaatgcttgtgtgcaacaaggcaactgtacaaaaccatttatgtttgacatttcaagaattttcacttgctgtctaccaggcttacctgaaacttcttcttgtgtttgtccaggatatatcactgttgtgtcagtatctaataatcctgtgatcaaggaattgcagaatcagcctgtgcgaatagttctcattgagggtgacctcacagagaattaccgccacctgggatttaataagtctgcaaatattaaaacagtattagatagcatgcggcttcaagaagacagctcagaagaactgtgggcaaatcacgtgttacaggtgttaatccagttcaaggtgaaccttgtcctggtacaaggaaatgtgtccgaacgcttaattgaaaaatgtataaacagtaagcggttggtaatcggctcagtgaatggcagtgtgatgcaggcttttgcagaggctgcaggagcagtacaggtggcctacattacacaagtgaatgaagattgtgtgggcgacggggtctgcgtgaccttctggagaagcagccctttggatgttgtagataggaacaacagaatcgcaatcttattaaaaacagaaggaattaatttggttacggccgtgctcactaacccagttactgcacagatgcaaatcaaagaagataggttctggacatgtgcctatcgtttgtattatgctctaaaagaggaaaaggtcttccttggaggtggtgcagttgaatttttgtgtcttagctgtcttcatattcttgcagagcaatctctgaaaaaagaaaaccatgcctgctcagggtggctgcataatacttcctcttggctggcttcatctctggcaatatacagaccaactgtgcttaaattcctggcaaatggatggcagaaatacctttcaactctcctatataacactgccaattactcatcagaatttgaagccagcacatacattcaacatcatctgcaaaatgccacagactctggctctccttcatcttacatcttgaatgaatatagtaaactaaatagtagaatttttaattcagacatttcaaataaactggagcagattccgagagtttatgacgttgttacaccaaagattgaggcgtggcgccgagcattggatttagtattgttagtacttcagacagacagtgaaataattactggacatggacacacacagataaattcacaggaattaacgggctttctatttttgtagtgttactggctaagtctttggaaaataatttttcataatatgtcatgctaataataaatatattgatagccaagtcatggtgcctaaaatgccagctattgccaagaagaaaatagttgatgtctgtcaataactgtgcatggtctgagattttaccctacttataagctaacaagttagcctgttactgtttcgtgggatgctacagaatgcataagacacctgggtcagaaacaaaggacttatcgctcacagcaaaagctgtagccagagcttcatgttggttttattcagttcctcatttttctagttcccacaggaggaacacaaagggcccatgatgaaagcctgcacacagtgggttatgttgtaagcttgggttattaactgcttttatagtaagcaaaaaaatcctggtctttgtccaaagggagttattaccccatacttgaagatagcttagtgtaaacacaagcctaggacatggactaggtaaagacaaagtccttgcattcttgacatacccagtaagtatgcagggacactcagagcccatagtggatagtctcttccaacagtctgctcctcagcctgagatgttcttggccaaacttgaattttcacatgagtatgccactctatcagctactctgattaacctgacagtcgggttgtttagtcagtaccaaatttgttcatttggtctcatatagcaattaatgcaggctattatcagacacagcagcaggatgaagccaacctgcagtattaacctcagtcctgtcccccaaggtcttgactcaatcaactctaagttccaagggaggaccaataggtctttttattaggcagccagaatgtagtgaaggacaatttattatactttatgacccaataaagggagctttgactgacgta

SEQ ID NO: 3134 - DNA, 859 bp, Homo sapiens
tttggtgttgctgtcccagccagaatcgcgtctggccggtgggaagccgggaactccagccccctgtaggagaggagaaaggagcgaggcaggagaggaaaacaagtgcaaagtgcattcttgaagcactctgtcaaatcacttttcatgcttcattgagtagaaacatggcacattttccaaagccatcagcctgtcttgttcatattatatcccagacagacacgcaagtattgtaatcattgataaaaatctcattaggcttctggaaaatagatcatgatacatggtgatggcttgcagagtcgtaaacaaaagaagacacatgggacttcaacaactttcatcattcgcggaaacaggaagaactttcctaggcccactaaaatcatccaaatttattatagatgaagaatgtcatgaaagtgtattaatcagttcaacagtaaggcttcttgaaagtttggatttaaccagtgcagtgggacaacttctcaatgaagcagttcaagcacaaaacaacacatatagaactggaatcagtactcttttgtttcttgttggtgcttggagcagtgcagttgaagaatgtcttcatcttggtgtccccatttccataatagtatcagtaatgtcagaaggcttaaacttttgtagtgaagaggtagtttctcttcatgtacctgttcacaatatatttgactgtatggacagcacaaaaacattttctcaacttgaaacatttagtgtaagtttgtgtccttttctacaggtcccttcagatactgatttgatagaggaattgcatggtctcaaagatgttgcctctcaaacactgaccatttccaacctttctggg

SEQ ID NO: 3135 - DNA, 3431 bp, Homo sapiens
gtctcttagcaactaagcccccggctcctccagaagcccctcttcgcacatgcgcaaactgcggacggggaactgggctccctagccctggcgtttttggtgttgctgtcccagccagaatcgcgtctggccggtgggaagccgggaactccagccccctgtaggagaggagaaaggagcgaggcaggagaggaaaacaagtgcaaagtgcattcttgaagcactctgtcaaatcacttttcatgcttcattgagtagaaacatggcacattttccaaagccatcagcctgtcttgttcatattatatcccagacagacacgcaagtattgtaatcattgataaaaatctcattaggcttctggaaaatagatcatgatacatggtgatggcttgcagagtcgtaaacaaaagaagacacatgggacttcaacaactttcatcattcgcggaaacaggaagaactttcctaggcccactaaaatcatccaaatttattatagatgaagaatgtcatgaaagtgtattaatcagttcaacagtaaggcttcttgaaagtttggatttaaccagtgcagtgggacaacttctcaatgaagcagttcaagcacaaaacaacacatatagaactggaatcagtactcttttgtttcttgttggtgcttggagcagtgcagttgaagaatgtcttcatcttggtgtccccatttccataatagtatcagtaatgtcagaaggcttaaacttttgtagtgaagaggtagtttctcttcatgtacctgttcacaatatatttgactgtatggacagcacaaaaacattttctcaacttgaaacatttagtgtaagtttgtgtccttttctacaggtcccttcagatactgatttgatagaggaattgcatggtctcaaagatgttgcctctcaaacactgaccatttccaacctttctgggagacctcttaaatcatatgaattatttaaacctcagacaaaggttgaagcagataacaacacatcacgaactctgaaaaacagcctgcttgcagatacctgctgcagacagtcaatactaatccacagtaggcattttaataggacagataatactgaaggggtaagcaaaccagatggatttcaagaacatgttacagctactcacaaaacttacagatgtaatgatttggtagagttggcagtaggcttgagtcatggagatcacagcagcatgaagttagtagaagaagcagtacagctgcaatatcagaatgcttgtgtgcaacaaggcaactgtacaaaaccatttatgtttgacatttcaagaattttcacttgctgtctaccaggcttacctgaaacttcttcttgtgtttgtccaggatatatcactgttgtgtcagtatctaataatcctgtgatcaaggaattgcagaatcagcctgtgcgaatagttctcattgagggtgacctcacagagaattaccgccacctgggatttaataagtctgcaaatattaaaacagtattagatagcatgcggcttcaagaagacagctcagaagaactgtgggcaaatcacgtgttacaggtgttaatccagttcaaggtgaaccttgtcctggtacaaggaaatgtgtccgaacgcttaattgaaaaatgtataaacagtaagcggttggtaatcggctcagtgaatggcagtgtgatgcaggcttttgcagaggctgcaggagcagtacaggtggcctacattacacaagtgaatgaagattgtgtgggcgacggggtctgcgtgaccttctggagaagcagccctttggatgttgtagataggaacaacagaatcgcaatcttattaaaaacagaaggaattaatttggttacggccgtgctcactaacccagttactgcacagatgcaaatcaaagaagataggttctggacatgtgcctatcgtttgtattatgctctaaaagaggaaaaggtcttccttggaggtggtgcagttgaatttttgtgtcttagctgtcttcatattcttgcagagcaatctctgaaaaaagaaaaccatgcctgctcagggtggctgcataatacttcctcttggctggcttcatctctggcaatatacagaccaactgtgcttaaattcctggcaaatggatggcagaaatacctttcaactctcctatataacactgccaattactcatcagaatttgaagccagcacatacattcaacatcatctgcaaaatgccacagactctggctctccttcatcttacatcttgaatgaatatagtaaactaaatagtagaatttttaattcagacatttcaaataaactggagcagattccgagagtttatgacgttgttacaccaaagattgaggcgtggcgccgagcattggatttagtattgttagtacttcagacagacagtgaaataattactggacatggacacacacagataaattcacaggaattaacgggctttctatttttgtagtgttactggctaagtctttggaaaataatttttcataatatgtcatgctaataataaatatattgatagccaagtcatggtgcctaaaatgccagctattgccaagaagaaaatagttgatgtctgtcaataactgtgcatggtctgagattttaccctacttataagctaacaagttagcctgttactgtttcgtgggatgctacagaatgcataagacacctgggtcagaaacaaaggacttatcgctcacagcaaaagctgtagccagagcttcatgttggttttattcagttcctcatttttctagttcccacaggaggaacacaaagggcccatgatgaaagcctgcacacagtgggttatgttgtaagcttgggttattaactgcttttatagtaagcaaaaaaatcctggtctttgtccaaagggagttattaccccatacttgaagatagcttagtgtaaacacaagcctaggacatggactaggtaaagacaaagtccttgcattcttgacatacccagtaagtatgcagggacactcagagcccatagtggatagtctcttccaacagtctgctcctcagcctgagatgttcttggccaaacttgaattttcacatgagtatgccactctatcagctactctgattaacctgacagtcgggttgtttagtcagtaccaaatttgttcatttggtctcatatagcaattaatgcaggctattatcagacacagcagcaggatgaagccaacctgcagtattaacctcagtcctgtcccccaaggtcttgactcaatcaactctaagttccaagggaggaccaataggtctttttattaggcagccagaatgtagtgaaggacaatttattatactttatgacccaataaagggagctttgactgacgt

SEQ ID NO: 3136 - DNA, 2814 bp, Homo sapiens
cacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgttaaactttgtgttgattgattataaaatcaccaccaaatcag

SEQ ID NO: 3137 - DNA, 2490 bp, Homo sapiens
aaccgccgacttccggccgcgcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatga

SEQ ID NO: 3138 - DNA, 2472 bp, Homo sapiens
atggctcttaccgtagtgccatctttttctgtctcgggggtttggaagagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatg

SEQ ID NO: 3139 - DNA, 1876 bp, Homo sapiens
gcagcggtgggctgagctaaaatggctgaggagagagtcgcgacgagaactcaatttcctgtatctactgagtctcaaaaaccccggcagaaaaaagggggagttggagtgagcaatgatttggaataccagaaattcaacttatatatttacagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctt

SEQ ID NO: 3140 - DNA, 1974 bp, Homo sapiens
aaaccgccgacttccggccgcgcagcggtgggctgagctaaaatggctgaggagagagtcgcgacgctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattggcctaggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactga

SEQ ID NO: 3141 - DNA, 3475 bp, Homo sapiens
aaactgcagggattacaggcagaagccaccatgcccggctaataacctgaatctcttgacggtgaagagaaataaggagaggggtaaaatggctaaaggatgtctgtttggaggcaaggaaggtcgcccagaggtcaggcacgctccccttggcggacacagctgggcttctcagagactcctaaatcctgcctcgcatctcaaatcggcttaacgacgcgaaagagctgggcgacgcgcgcgcactctcgcggaagcttgagtctcggcgcccgccgtagacgtcgtgacagaggcggcccgttgccttggagccagagagacgcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattcgttcaataaagattagagattcaaaatttggtttagctcttgtcatagaaagctctcagcagagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagcaacaagatcgtgaacctgtattttcagaagaactggggcttgcaatagagaaattgaaggatggattcaccctacagggactttgggaagtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaaccgtccggccgcggcgctggcttaagccatggctgagggtagctggattcctcaggcccgggcgctcctacagcagtgcctgcacgcccggctgcaaattcgcccagccaatggggacgttgcggcccagtgggtggaggtccaaagaggactggtgatctacgtgtgctttttcaagggagctgataaagaacttcttcccaaaatggccgaagctggactgtactgctgccatctctggctcactgcaacctccctgcctgattctcctgcctcagcctgccgagtgcctgcgattacaggcgcgcgccgccacacctgactggttttcgtatttttttggtggagacggggtttcgctgtgttggccgggctggtctccagctcctaaccgcgagtgatccgccagcctcggcctcccgaggtgccgggattgcagacggagtctggttcacttagtgctcaatggtgcccaggctggagtgcagtggcgtgatctccgctcgctacaacctccacctcccagctgcctgccttggcctcccgaagtgccaagagtgcagcctctgcccggccgccaccccgtctgggaagtgaggagcgtctctgcctggctgcccattgtctgggacgtgagcagcccctctgcctggctgcccagtctggaaagtgaggagcgtctctgcccggccgccatcccatctaggaagtgaggagcgcctcttcccacccgccatcccatctaggaagtgaggagcttctctgcctggccgcccatcgtctgagatgtggggagcacctctgcccggccgcgaccccatttgggaggtgaggagcaactctgcccagccgccccgtctgagaagtgaggagaccctccgcctggcaaccgccccgtctgataagtaaggagcccctctgcccagcagccgccccgtctgagaagtgaggagcccctctgcccagcagccaccctgtctgggaagtgaggagcgtctccgcccggcagccacccagtccgggagggaggtgggggggtcagtcccccgtccggccagccgccccgtccgggaggtgaggggcgcctctgcccagctgcccctactgggaagtgaggagcccctctgccccgccagccaccccgtccgggagggaggtgggggggtcagccccccgcccggccagccgccccgtccgggagggaggtgggggatcagccccccgcccggctagccgccccgtccgggaggcgaggggcgcctctgcccggctgcccctactgggaagtgaggagcccctctgcccggccagccgccccgtccaggagggaggtgggggggtcagccccccgcccggccagccgcccggtccgggagggaggtgggggggtcagccccccgcccggccagccgccccgtccgggaggttaggggcgcctctgcccggccgcccctactgggaagtgaggagcccctctgcccggccaccaccccgtctgggaggtgtacccaacagctcattgagagcgggcgatgatgacagtggcggctttgtggagtggaggtggggggaaggtggggaaaagattgagaaatcggatggttgccgtgtctgtgtagaaagaagtagacatgggagacttttcattttgttctgtactaagaaaaattcttaccctaaaacttaaagtataataaaaaaaaaaaaacttcagttttctaaaaattatatttaaaattgtaatcaaaatgtacctagtttataaatgtttattttgtacttaatacctgtaaagtcttagttttcagacattaagtgactgtatcatgttcggtttaataaagaatttatgcagcacca

SEQ ID NO: 3142 - DNA, 3107 bp, Homo sapiens
gccttggagccagagagacgcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagcaacaagatcgtgaacctgtattttcagaagaactggggcttgcaatagagaaattgaaggatggattcaccctacagggactttgggaagtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaaccgtccggccgcggcgctggcttaagccatggctgagggtagctggattcctcaggcccgggcgctcctacagcagtgcctgcacgcccggctgcaaattcgcccagccaatggggacgttgcggcccagtgggtggaggtccaaagaggactggtgatctacgtgtgctttttcaagggagctgataaagaacttcttcccaaaatggccgaagctggactgtactgctgccatctctggctcactgcaacctccctgcctgattctcctgcctcagcctgccgagtgcctgcgattacaggcgcgcgccgccacacctgactggttttcgtatttttttggtggagacggggtttcgctgtgttggccgggctggtctccagctcctaaccgcgagtgatccgccagcctcggcctcccgaggtgccgggattgcagacggagtctggttcacttagtgctcaatggtgcccaggctggagtgcagtggcgtgatctccgctcgctacaacctccacctcccagctgcctgccttggcctcccgaagtgccaagagtgcagcctctgcccggccgccaccccgtctgggaagtgaggagcgtctctgcctggctgcccattgtctgggacgtgagcagcccctctgcctggctgcccagtctggaaagtgaggagcgtctctgcccggccgccatcccatctaggaagtgaggagcgcctcttcccacccgccatcccatctaggaagtgaggagcttctctgcctggccgcccatcgtctgagatgtggggagcacctctgcccggccgcgaccccatttgggaggtgaggagcaactctgcccagccgccccgtctgagaagtgaggagaccctccgcctggcaaccgccccgtctgataagtaaggagcccctctgcccagcagccgccccgtctgagaagtgaggagcccctctgcccagcagccaccctgtctgggaagtgaggagcgtctccgcccggcagccacccagtccgggagggaggtgggggggtcagtcccccgtccggccagccgccccgtccgggaggtgaggggcgcctctgcccagctgcccctactgggaagtgaggagcccctctgccccgccagccaccccgtccgggagggaggtgggggggtcagccccccgcccggccagccgccccgtccgggagggaggtgggggatcagccccccgcccggctagccgccccgtccgggaggcgaggggcgcctctgcccggctgcccctactgggaagtgaggagcccctctgcccggccagccgccccgtccaggagggaggtgggggggtcagccccccgcccggccagccgcccggtccgggagggaggtgggggggtcagccccccgcccggccagccgccccgtccgggaggttaggggcgcctctgcccggccgcccctactgggaagtgaggagcccctctgcccggccaccaccccgtctgggaggtgtacccaacagctcattgagagcgggcgatgatgacagtggcggctttgtggagtggaggtggggggaaggtggggaaaagattgagaaatcggatggttgccgtgtctgtgtagaaagaagtagacatgggagacttttcattttgttctgtactaagaaaaattcttaccctaaaacttaaagtataataaaaaaaaaaaaacttcagttttctaaaaattatatttaaaattgtaatcaaaatgtacctagtttataaatgtttattttgtacttaatacctgtaaagtcttagttttcagacattaagtgactgtatcatgttcggtttaataaagaatttatgcagcacca

SEQ ID NO: 3143 - DNA, 1935 bp, Homo sapiens
gttgccttggagccagagagacgcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattcgttcaataaagattagagattcaaaatttggtttagctcttgtcatagaaagctctcagcagagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagctcgatagcatagcatctgaatgggttggacttccacctctgccttcagccaggtgtctcttcggtctgggagaggtggatgataaaatctatgtagttgcaggcaaagaccttcaaacagaggcttcgctggattcagtattatgctatgatcctgtggctgcaaaatggaacgaagtaaaaaaactccctatcaaagtctatggccataatgtgatttcacataaagggatgatatattgtctaggaggaaagacagatgacaaaaaatgtacaaacagggtgtttatcttcaaccccaaaaaaggagattggaaagatctggctccaatgaaaattcctcgttccatgtttggagtagcagtccataaaggcaaaattgtgattgcaggaggtgtcactgaagatggtctttcagcttcagttgaagcttttgaccttacaacaaataaatgggatgtaatgaccgaatttccccaagaaagaagctccatcagtttggtcagcctggctggatctctgtatgcaattggtggttttgctatgattcaactggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaaactgtgaacaaggtgacaaaacataatagattgggaggtggtttgtttggtgaatggggctttaatttattctgttttttaaaagcttgtacagacactcatgtagaaattattcaagaagttattgtctaagagatgagcagtaggtaagaaaacctcagtcattgactcttcaatgtaatgatcagagtttaaaaccattttctaataataaattaaatcttcagttgaac

SEQ ID NO: 3144 - DNA, 3752 bp, Homo sapiens
gacgtcacgcaggacgccactgccctgtcgccccgcctgtgcagcccaggacctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataaggtaaagtcccaaagaagtggtctgtttaaatgaaaaatgttaaaagagaattagaagttaactgtgtatgtactttaatttcaaatgcttttttatatctaaaaatatttgagatataatggctttttaaagtaatgcttctatttcttttgacaaattgaactttctaaaactaaaagagtctttttatttttaaaacacaagtagaatgatttaaataggattttaatgaatttttggcaagtggctgttttaatttttaaattgagaagtaatatgtggaaaattaaaatatattcaaatgtattacaaggtacataaacacataaacatgtagaccgctttataggcttcaaaatgtatttttatatattaccttatttgatcttcacaactgttgtaaaatttgtcaaatcatataagaaaactgattctcagtgaaattttgtgattaagaggacatgctaatattttgtaaagctgggaccagaacccaagtactggtacttgctttgtgtcctggttactatgtatgttgccagctagtggaaataacctaccaattgttttttctaggagataggattgatttgcaactgatattccttttgcttggtagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaatggcatacagataatggaaaataagctttatgtttcaagaagggcagactcacgaattttttagaaaacagtgcttcttaatgatatgctattatacttattagttatgtgcaagctttgtatattcttatatttatatataaatataaaaatttgttaaaggcacgtatagttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaacacaatttctggttactatgaataaacgcctaaatgttaagatga

SEQ ID NO: 3145 - DNA, 2570 bp, Homo sapiens
aggacctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggttagtggaccattctagaataccttgccatatttcttttcaactggctatttcccaaggatcatgtaagagaagctgggcagaaagataaaaagattacatcagtcatgattcatgaaccagtcatgaatcagttgacaacaaatttattgcacagaatatttctgtattttgtcaagctacttttaatatttaattcttttacttgataaaatgcaagtatattaagaaataagtatactgtgatgaattaatctatatatatgaacaaacctggtataaaatgaatgtaatctatgaacctttagagcttagactgtatttcacacaaataattgtcatgttttgttgctattgtgaattataaaaatgcagcatttaaaatttttaaggcaaaatttaataaaggatatacagta

SEQ ID NO: 3146 - DNA, 734 bp, Homo sapiens
gatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaa

SEQ ID NO: 3147 - DNA, 4027 bp, Homo sapiens
acctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 3148 - DNA, 3899 bp, Homo sapiens
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 3149 - DNA, 3914 bp, Homo sapiens
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagtctgaatgttttaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 3150 - DNA, 4004 bp, Homo sapiens
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 3151 - DNA, 1959 bp, Homo sapiens
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgaattttccctcttag

SEQ ID NO: 3152 - DNA, 3914 bp, Homo sapiens
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgaatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 3153 - DNA, 4019 bp, Homo sapiens
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagtgcaaaatagtttaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 3154 - DNA, 1581 bp, Homo sapiens
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcaattttctttatggaagcatttgttgcctcgatcttccactttagaaaaatga

SEQ ID NO: 3155 - DNA, 613 bp, Homo sapiens
cccacccacacgcaccgaggggagagggcggtcacgcggccgggggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgtttgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgtt

SEQ ID NO: 3156 - DNA, 1982 bp, Homo sapiens
tgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtaagagactggatggccttcacaagcgttagttaagtcagaagcagtgacaatctggtcagtttttgtcataccagagagcattccgcaaagctgcttgttttccaatttcttcattcttccccttagcactggtgcagctgaatttgatcctttgtgtattcctgtcactattcagatcttttctctctctttctctcttactctctttttttccagaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtc

SEQ ID NO: 3157 - DNA, 1717 bp, Homo sapiens
attttctaatttaagtgaaaccactagtgtcagcagacaaacgtgtgagctgaacttgacatccttttcttcaactgctcccttctcaaatattttcaaactagaggagcctttctaaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagtatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttc

SEQ ID NO: 3158 - DNA, 2341 bp, Homo sapiens
acggtgctgacgggcccccggagcggcgagggcgcggagagaggacctccccggccaggtggagagtcatgagccgcgggcagccgccgccgctctccgcggtgctgatgccgccaggtgcgctcctttccgcccgctgctagcgcggcccgggcccgcagctatctgcggtgctgacctggccaccctcagccaccacttgcctggaagaagcgtgcggtttggatttttaaaacgccattctttatttagattccaacatcctcgcgtttcttctgtgccaagggggccctcgggccgtccgtctccccctttgctctccccaacttggcgcgccctccctcccattcctccctgacactcccaccaccccccctcggctcggcggctcggcgcgatgctgcagaagacgcactgagcccttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtataaagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggactaaatggaagcgacagacggccgtcgggttggagctgctggcggaggcaggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccgcgggctcggcgtggccccttccgcccgcctttctgagggcgcaggttcgacgccctttcccgggagggggccctgcccggccctccctggcgccccagcccagtgccccccgaagggccaaatgccaagtccactgaggcccggaccccggactgcgtctccccagcccccctcggcgtcctctctcgcggccgctctgtccgggagccatccccacccgccgggtgtacatacgcgtctctgccactccccacccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtcc

SEQ ID NO: 3159 - DNA, 1197 bp, Homo sapiens
aggctgaactccgtccaaggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtataaagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggactaaatggaagcgacagacggccgtcgggttggagctgctggcggaggcaggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccgcgggctcggcgtggccccttccgcccgcctttctgagggcgcaggttcgacgccctttcccgggagggggccctgcccggccctccctggcgccccagcccagtgccccccgaagggccaaatgccaagtc

SEQ ID NO: 3160 - DNA, 1155 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagggcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcatga

SEQ ID NO: 3161 - DNA, 946 bp, Homo sapiens
gtcaagcctaagtccttgagttccgggtccgggcagcagagaaaggaagtcctctccctggaggcctatctccctcagaactgcgcgagaagcgagaccttagaaggcagggcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttca

SEQ ID NO: 3162 - DNA, 670 bp, Homo sapiens
gaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccgggg

SEQ ID NO: 3163 - DNA, 586 bp, Homo sapiens
ccgggcagcagagaaaggaagtcctctccctggaggcctatctccctcagaactgcgcgagaagcgagaccttagaaggcagggcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaataattaagcctgatcaagatgacaacctcccaaaagcaccgagacttcgtggcagagcccatgggggagaagccagtggggagcctggctgggattggtgaag

SEQ ID NO: 3164 - DNA, 1135 bp, Homo sapiens
gccgcggagcagggccctgattggaggccagaggggttgcggggagaaggggaggagaggggtcgcaggcgctgtggcgggccctgggggagagcttggccgcgctgcggggagggggcggggtgcagcgcgtgggagccgggccgcgggaaggggcgggccgcagcggcgcgcggtgggggcggagctggggcgcggcgtgaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaataattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataa

SEQ ID NO: 3165 - DNA, 3472 bp, Homo sapiens
agagggaaggtgagagggcaaggagtaaaggtggctgggtgtgggtccgttgaagcgagccgcctccagccctgttgaactggtgggcccagggactggagcgggattgaaagggatcttgctctcccttgaagccttgagttgcagcgatttcagtgtcttctctccctgtgtaagcctgtctcggtgtttaggctgaactacagccaccccctctcccgggggtgtgcaggccagggactggccaggcagccatggctgacgagaagaccttccggatcggcttcattgtgctggggcttttcctgctggccctcggtacgttcctcatgagccatgatcggccccaggtctacggcaccttctatgccatgggcagcgtcatggtgatcgggggcatcatctggagcatgtgccagtgctaccccaagatcaccttcgtccctgctgactctgactttcaaggcatcctctccccaaaggccatgggcctgctggagaatgggcttgctgccgagatgaagagccccagtccccagccgccctatgtaaggctgtgggaggaagccgcctatgaccagagcctgcctgacttcagccacatccagatgaaagtcatgagctacagtgaggaccaccgctccttgctggcccctgagatggggcagccgaagctgggaaccagtgatggaggagaaggtggccctggcgacgttcaggcctggatggaggctgccgtggtcatccacaagggctcagacgagagtgaaggggaaagacgcctaactcagagctggcccggccccctggcctgtccccagggccctgcccccttggcttccttccaagatgacctggacatggactccagtgaaggcagcagccccaatgcatctccacatgacagggaggaagcttgttccccacaacaggaacctcagggctgcaggtgcccgctggaccgcttccaagactttgccctgattgatgccccaacgttggaggatgagccccaagaggggcagcagtgggaaatagccctgcccaacaactggcagcggtacccaaggacaaaggtggaggagaaggaggcttcggacacaggtggggaggaacctgagaaggaagaggaagacctgtactatgggctgccagatggagccggggacctcctcccggacaaggagctgggttttgagcctgacacccaaggctgagatgtttgtgctccgtagcttctagtctggaactgctgctgacccctgtgtgacatcacagggcctcagtttccctatctgcaaaatgggatgatatggaggttcaatgagatggtggcattttgagaatggtaaagaaatacacagggaggggatgatgactattagtggactcttgtttttccaatagttagtggtctttggccaacctttgaaggcaaaatatgatttgttgaggtttgcagcagctgaagccctcaaaagcattttccaccttcccccaaagctgacctctgagaggaaccttccttggtgctccctctgggcccctgatcctttgtgaaggccagtcaggtttcccattcctattgtgtcttatagtccacttggtagatggcgtgatccgtctttacacagagggagcctcatctcctcctgggccacattcctcctgcagctcccatcgctccttggccaggacccaaaaccttctgtgactgacccctgctgacctcattctctctgctcctccagttccaagcctagcccccctgcccatcttgcggctcacactcttgcccaagctgttctcctccaccaggatgcccttggctcccttttcagcttggcaaattcgtgctcacccttcaaacccctacacagatgacctcccttggaaaggttttcctgatgtcgctgcctcctggaaccaggtggtcttgcctctctgcgctgcctttgggacctgtatatttgtcagtgtggcatggctgcctgcctcccgttgaagggcagcatcttgactttactcaccttgagatcgcctgtgcccagatgggcctttggcctggcccagaatcggtggtcatcaagggtgtacagaactcaccaggacccaggaacctgttgcagataaaatcactctcccccacgttcccaacttttagactcacagccctcttacttcccagcattcaaacttctaaatggcctgtatgtattcacaaagcaggcaaaaagcccccagaggaacaccaccccccacccctgcctctggaatacatttgctttgacttggaattgtaggtgaaattcatcttcctggcctacttcagtttgaatcagttggctagccaggtgcggtggctcatgcctgtaatctgagcattttgggaggctaaagtgggtggatcacttgaggccaggagttggagagcagcctgggcaacatagcgaaaccctatctctactaaaactacaaaaattagctgggcgtggtggtgcacacctgtagtctcagctacttgggaggctgagctggaggatagcttaagcacaggagatggaagttgcagtgagccgagatcgcaccactgcactccggcctgggtgacagagtgagaccctgcctcaaaacaaaacaattggaattggatggcatttagtgagcatctactatatgccagatattgagctgtgatctctaggggtaaagagacatgaactactgacaccgtgcttgccttcagagggctcacaatctagtgagcttgatttctgtgagtgcagagcagaagctgaggtgggaacagagaagtaaaaaatggacacaccagaggcagaagagtgacagcctcccagctgtttggggcagttgagtatggtggggaaatagctcaagctgtctttgcagcccctgaagacatcactgtaccctattgaaccatctcagggtgatgctattgttacgctgatccctgcaacgcttgcctgtgccccagcccaggatcctggcagctgcagagaaaatggcagtaacactacctcaaaccaggaccacgccctcagagcctgcaccctgggccacctgggagtcagagaccttcacctgggctatggggttctgggttgaggctggggttcccggcctagggaagggcttccgggttgaggccgggggtcctggcctagggaaggagatgcccctgtgtgctgggttacaaggtcatggccctgggaacacacttccttttctttctgggtcatttctgcctctgcagtgaaggatgccacagggtacaccctctctgctgtcatgactcaggacaggagttcctggtcacagctgagtcttcggatgaggtgaggggtagcatgctcctgtgctctgttgcctaaggcagggcagcctacaacccacgttagaaacagcgtcagcactaagggctaaaataaaactactttcaacatttaaa

SEQ ID NO: 3166 - DNA, 1809 bp, Homo sapiens
cggcgtggggagggggcgcagtcccgggttcgaccggccgagccccgcgcgccccgcccgcgccctgcgcctccgcccggccggccggcgggggagggggcatgagccggcgcccgcgcgccgccccgagctgcgggccggcctagagccccgcgcgggccccgcgccggagccaagccgtcgccgccgccgccgccaaaccgcgggcgcagcagtgggcgccgcgatgcagcggccgggggagccgggcgccgcgcgcttcggcccgcccgagggctgcgcggaccaccggccgcaccgctatcgcagcttcatgattgaggagatcctcacggagccacccgggcccaagggcgccgcgcccgcagccgccgctgccgcggcgggcgagctgctgaagttcggcgtgcaggcgctgctggcggcgcggcccttccacagccacctggccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaatcgggctcggtggagcagcttctgaatccgcagggggtgagggtgggggtgggggtgggctcggcaagataagcggaacgcgggcagttgcttcttaaacttcctttcctccggctctgtcgaaggcagctgtgctcttcaccatcaagcccgggctaggcacggcgggcggctcggtggctgcaggatcctaggaatcgcttccactctgggcgtgaggggccagtctgaactccacctcctctcccttgccagccagagagtcgctggcaggagcggtc

SEQ ID NO: 3167 - DNA, 1323 bp, Homo sapiens
gcctggggaactccaggacagaacacggacagggtcgaggagatactccctcccaaatctggggaacggcaacgttgaggagggtctccatctgcgccaccggcgccgaccggcagggcgtggaggttttgcgctgggaggcactggccaagcgcgagcacccccgcggcacgtggtgcggcagtccctggggcagaggagcgcggccgtagctcacccgggtcctcattctctttcttcgcagccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaa

SEQ ID NO: 3168 - DNA, 1810 bp, Homo sapiens
ggggcccaggccccgccgtcgcgccagccccgcggccccagcgggccgggcactcgcagccgcgctcgggccggcggacgctcgcgccggctcaccatgcactgccacgccgagctgaggctgagctcgcccggccagctcaaagcagccaggcggcgctacaagactttcatgatcgacgagatcctctccaaggagacctgcgattactttgagaaactttccctctactccgtgtgcccgtcgctggtcgtgcgacccaagcccctgcattcctgtacgggctccccttccctgcgggcatatccgctcctctcggtgatcacccgccagcccactgtcatctcccacctggtccctgccaccccgggaatcgcccaggcactgtcctgccaccaggtcaccgaggcggtctctgctgaggccccagggggcgaggccctagccagcagcgagtcagagacggaacagcccacgccccgacagaagaagccccgccggagtcgcaccatcttcaccgagctgcagctcatgggcctggagaagaaattccagaagcagaagtatttgtcaaccccagacaggttggacttggctcagtctctgggactcactcagctgcaggtgaagacctggtatcagaatcgcaggatgaaatggaagaaaatggttcttaaaggtggacaggaagcacccacaaaacccaaaggtcgccccaagaagaactccatccccacatcagaagagattgaagctgaagagaagatgaacagccaggcccagggtcaggagcagctggagccctctcaggggcaggaggagctctgtgaagcacaggaaccgaaagcacgtgatgtccccttagagatggcagagccaccagacccgccccaggagttgccaataccctcttcggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttattttttaattaaaaataaatctttcaaaa

SEQ ID NO: 3169 - DNA, 2430 bp, Homo sapiens
ggccgagctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacacc

SEQ ID NO: 3170 - DNA, 2434 bp, Homo sapiens
ggccgagctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacctccatccccaacccatcctcatccccaactacagccccaaacccagccccagactaatccacagccatccccaactcatcctcatccccaactgcagccccaaacccaacccagggccatccccaaacccatccccaagccaaactcaacaccatccccttccctaatcacctctcctgcccctagctcagcctcatccccaactccatgcctgtctccaatcccaaccctgcccccaatctcccctcaactccaatccataacccccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactcc

SEQ ID NO: 3171 - DNA, 1294 bp, Homo sapiens
aatatctcaggacccaggaccatgtgatatgggcccaacacctggatgatgttactcttctgcctaggtcatgcgtaaagagggaattagggcatattgcttggcccagtcccgtaatgatatgactctcctgcttgtgccagagccacagaagtgtgcttggtgacataatctttgaggctgtcacatcaccaagattatattgtatcactggaccagcataaagctgacacttctgactatgcccagccttcaaataatactacactgtataattggctcaacacccaggtgatattgttccatttacctgagaccagataaaaagcctaatgatgacgcttgtccccagagccaggacacgtgcaggacaggatcattactctcatccctgccccagattttcacaggtgctgcttacagagggcatcatgacatattgcttgacaaagaacctaagtgatgttaatattctgcataggttgctaaaaaatgggaatgtgagaaataccttgcttcagtccaaagtgggcttgctgacatattatgtgaaactgtacccgggtgaagtgactcttctgactaggcccagcatacaaatgagattatgctgtatcactggctcagtgtcgaggcccagatcacagaagtaattgtgccatatgtggaacaagcagctaagcaatagataacatccatcgtggctctgccttcaaagggaaattttacatatgtcactgggaccatcacccagatgatgtcctgcccactaaaagaattgtgacataacgctgactgcaaaaactgggtaatgcaactctcctctttattctggagtctgccaaaacaagggattatcacatattgcggagtccagcacccaggtgatgtgagtcttctctgtttctctaagattataatgtatcctgagctcaccatccaggtgatgagactctcctgctctgtttctgcccgcaggtaaaattttgtcatatacccagcttcagataccatgcaataatacaactatcatacctggacccaaagaggagagatattttgattctcattgccattcttatggccacaagcaaagtaatggttctcatagtggtataaagttcacacagtattatgacactcccagcgtatcatagaaaatgtgagtagtacaatgagtgttataacagggaacagcaaaccaatgctattgtgattattggattcacacccagctgacgcgactatcattctctcacaagaacagaacctgcaaataaagtactaaatctca

SEQ ID NO: 3172 - DNA, 1206 bp, Homo sapiens
aatatctcaggacccaggaccatgtgatatgggcccaacacctggatgatgttactcttctgcctaggtcatgcgtaaagagggaattagggcatattgcttggcccagtcccgtaatgatatgactctcctgcttgtgccagagccacagaagtgtgcttggtgacataatctttgaggctgtcacatcaccaagattatattgtatcactggaccagcataaagctgacacttctgactatgcccagccttcaaataatactacactgtataattggctcaacacccaggtgatattgttccatttacctgagaccagataaaaagcctaatgatgacgcttgtccccagagccaggacacgtgcaggacaggatcattactctcatccctgccccagattttcacaggtgctgcttacagagggcatcatgacatattgcttgacaaagaacctaagtgatgttaatattctgcataggttgctaaaaaatgggaatgtgagaaataccttgcttcagtccaaagtgggcttgctgacatattatgtgaaactgtacccgggtgaagtgactcttctgactaggcccagcatacaaatgagattatgctgtatcactggctcagtgtcgaggcccagatcacagaagtaattgtgccatatgtggaacaagcagctaagcaatagataacatccatcgtggctctgccttcaaagggaaattttacatatgtcactgggaccatcacccagatgatgtcctgcccactaaaagaattgtgacataacgctgactgcaaaaactgggtaatgcaactctcctctttattctggagtctgccaaaacaagggattatcacatattgcggagtccagcacccaggtaaaattttgtcatatacccagcttcagataccatgcaataatacaactatcatacctggacccaaagaggagagatattttgattctcattgccattcttatggccacaagcaaagtaatggttctcatagtggtataaagttcacacagtattatgacactcccagcgtatcatagaaaatgtgagtagtacaatgagtgttataacagggaacagcaaaccaatgctattgtgattattggattcacacccagctgacgcgactatcattctctcacaagaacagaacctgcaaataaagtactaaatctcaccaaaa

SEQ ID NO: 3173 - DNA, 3368 bp, Homo sapiens
gtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgccgccgcctggaggaggcggcggcggcagcgcgggaagtggcggcggcggcggcggcggggtgggtgtccccgggctgctagtaggttcagccggcgttgggggcgaccctagcctaagcagcctgccggccggggccgccctttgcctcaagtacggcgaaagcgcgagccggggctcggtggccgagagcagcggcggcgagcagagccccgacgacgacagcgacggtcgctgcgagctcgtgctgcgggccggagtagccgacccgcgggcctccccgggagcgggaggtggtggcgcgaaggcagccgagggctgctccaatgcccacctccacggcggcgccagcgtccccccggggggcctgggcggcggcggcggcgggggtagcagcagcggtagcagtggcggcggtggcggtagcggtagcggcagcggcggcagcagcagcagcagcagcagcagcagcaagaaatccaaagagcaaaaggcgctgcggcttaacatcaatgcccgagagcgccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggaggagatgcggcgcctagtcgcctacctcaaccagggccaggccatctcggctgcctccctgcccagctcggcggctgcagcggcagcagctgctgccctgcacccggcgctcggcgcctacgagcaggcagccggctacccgttcagcgccggactgcccccggctgcctcctgcccggagaagtgcgccctgtttaacagcgtctcctccagcctctgcaaacagtgcacggagaagccttaaacacacccccgaaaaacacaagaccgacccaaaatctagaggaaagcgaaaagctgctccccaccccctttattttggtcctctcgtagttgtgaaacacttgcagagcaaacaaagcagaggcaagaactgaggagaagtatcagagacaaacgggacttttagccttgacatccccagaatctcggtctttggggtggggagggagggaggagggaggtggagttgggatggagtatggatgtcttttttttctcagaaaagtggcaactttggtggcagcctagaccgcgaggaagtggaatcttccttaaaggtgaaacataagttgagaagtagtgcttggttattaagcctggagagtgtttgaatggcaaaatactaatcctactaataattgtggatttggctagtgctgagggggagaggaggggttaggggttgggtagcatgagagatggaatattcattcagacaaatcagaaagggcacttgaaaataaattttgattctgagccaggagaaaaacttgaaatgttgacttaagtgagggggaaataaaacccagagagagagagagagcgagagagagagacatgttactatgaaagacttgtattttttattgtctctgaactttaatcctgtgaaaatgctcaaagttttggcgagagtgatataaaaaaactgactgtggctgaaagaattgcatttaaaaatatttatgtgcaccttgttactttctactctgcaatgatgtattaacaattcatggtatttatttgttattcttcaatgacccttccacatcaacagtatttatcatgtgttaaagtcatgggtcttatgtgcagatttttttaatgcctctaaaattgttttatagattacttatgctgtgtgccaagtgtttaaaggtttatttgccaacaagtatgaagagaaatattgatgtatctgagctgcttaggtttatgaaaggtcacctggatattttcagttgcatcatccctgtatttaaattgagctttaataaattgcttcagtccaaaaattacaggaaaggtgtattcttaattgatgaatgaattgatctcttttttgaaaggggactcctttacattccaaaagggaaaaacatcacagcaatagttgctatacgtaagaacatgctaagcaaatatttttccaggctgtgctgtgcatttttaaaaggtctaatttaattgcttttaatatatatgtacatatatgttattttaactgtggagaattatttaagttaaaagactggtttgatttgcctatggtgtgaaatcctttgttatttttctaaaaaaataaaatttaaaaagaaagaaaactaaggaagaacaagaagctatttacccaaagtgagctttcagttttagttttgcatggctgtttgactgcctttccgccctatgaaaatcaagaaaatcttttttaaaaatggagtcctgctattttccactccttgcagataatacaaattcagtttgtcaggttggatggtgagttgggagctgtgatggatctgttggcgggttttggatgtgtaaagaatgatatatatattaaataggtcaatcagactatgacagctatgtacgaccatttgtatgtgtatctatgtcagaaagaatctttattaaaatattttgatc

SEQ ID NO: 3174 - DNA, 1057 bp, Homo sapiens
tgattggacagcagcgaggtcccaccgggcgcctccgcggcttaaaaccgaagcgggggcgagggggaggtagagcccgccccctgcgcgtcgcggctgggagggagaggaggtgggagagaaggaagaggcggaggaggcagcgggcgccgaggctctgggacccgcaggcaagccagaccgacgcgcagagccgggagcctcatcgcagcggcagcggcagcggcgggctcgggccggcctcgggggctgctcacccacatgagcatccgcccacccggcgagcccccgagcccaggcggcgcggccatggccgagctcaagtcgctgtcgggggacgcgtacctggcactaagccacggctacgcggcggcggctgcgggtctcgcctacggggcggcgcgagaacccgaagcggcccgcggctacggcactccgggcccgggcggcgacctccccgcggcgcctgcacctcgcgccccagctcaggcggcggagagcagcggcgaacagagcggggacgaggacgacgccttcgagcagcggcggcggcggcgcgggccagggagcgcggcggacgggcggcggcggccgcgagagcagcggtctctgcggctcagcatcaacgcgcgcgagcggcggcgcatgcacgacctaaacgacgcgctggacgggctgcgagccgtcatcccctacgcgcacagcccgtcggtgcgcaagctctccaagatcgccacgctgctgctcgccaagaactatatcctcatgcaggcgcaggccctggacgagatgcggcgcctggtggccttcctcaaccagggccagggcctggccgcgcccgtaaacgccgcgcccttgacgcccttcggccaggccactgtgtgccccttctccgcaggcgccgccctggggccctgccctgacaagtgcgccgccttctccgggacgccctccgcgctttgcaaacactgtcacgagaagccgtgaccgcgcgggcccccggccctcccgcacgcgtcctccgatcgcccctgtgactgtctctctgcccggacag

SEQ ID NO: 3175 - DNA, 3473 bp, Homo sapiens
gcggccgcagccgcagacacctgggggccggggctgggggtgggggctccctagcagccgccggagcgttgtccaacacgtgagactcatgtgatgaagccgggggagggcgggcaggtcgctccttccctccccggcagtggccagacgtgcctggagtcacagggtagaacacgtagctccaacccacccactcgctcccatttaacccagcccgcagcctctccattactcctcggcttgcccccccacccccccactccgccctaaccgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaagagaaagatggtctcctgagttttttaaaatagctcacttggtgtgatatggctgactcccatgtccttctttcttggctgaagcaaaccagttaatctcagtgtaatttcattcagcttttcatgtgctttgtattcaatcagaata

SEQ ID NO: 3176 - DNA, 980 bp, Homo sapiens
gagttaccagaaaccacaagagagagagagagcgtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaaggccgacaccctgcacctggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctgagcttccgatgcggggagagcagagcctcgggaggggcacacagactgtggcagagctgcgcccatcccgcagaggcccctgtccacctggagacccggagacagaggcctggacaaggagtgaacacgggaactgtcacgactggaagggcgtgaggcctcccagcagtgccgcagcgtttcgaggggcgtgtgctggaccccaccactgtgggttgcaggcccaatgcagaagagtattaagaaagatgctcaagtcccatggcacagagcaaggcgggcagggaacggttatttttctaaataaatgctttaaaagaaaccagtctgacaaggcagtttctc

SEQ ID NO: 3177 - DNA, 980 bp, Homo sapiens
ggggcagacgtgggacgggaaggacggctgccgggactggcgcgcggggacactgggccgacgcgtggagtagcggggagagcgggaagcctgagggggcggggccggcgcgaggccgtgggtgcggcacgaggatgccggcggcgggacagcgcccgtaggcagccccacgggcagggcgcgcgggcggggcggggcgggccgggccagaggagcgcccggcatgtcgcaagggctcccggccgccggcagcgtcctgcagaggagcgtcgcggcgcccgggaaccagccgcagccgcagccgcagcagcagagccctgaggatgatgacaggaaggtccgaaggagagaaaaaaaccgagttgctgctcagagaagtcggaagaagcagacccagaaggctgacaagctccatgaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatgaagccggggacactcctctgcccagcaaggagccttggtcattttcatacctgggaggaaggcttttccttcacaattgtatacagggggcacctgtggccaggcctcctcctgggagctccaggaccagccagctgtgttccctgcagactgggctcagcccgacatccaacaggcgccaaactcacagagcccttgtgcagatccagcatggaggccaccctcaggagtgacttctcatccaccctggcagctagtaggttctgctgttatgcagagccatttcctctagaatttggataataaagatgcttattgtctctcccttctccagttctgggaatttacaggcacaatacacttccttttcctgg

SEQ ID NO: 3178 - DNA, 897 bp, Homo sapiens
cttgaaggaagtggccttgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 3179 - DNA, 1237 bp, Homo sapiens
gctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacggtgtagtgtaa

SEQ ID NO: 3180 - DNA, 2004 bp, Homo sapiens
gtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctgccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctc

SEQ ID NO: 3181 - DNA, 1604 bp, Homo sapiens
agttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctc

SEQ ID NO: 3182 - DNA, 1656 bp, Homo sapiens
gtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctc

SEQ ID NO: 3183 - DNA, 1761 bp, Homo sapiens
agttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctc

SEQ ID NO: 3184 - DNA, 4610 bp, Homo sapiens
ggcgggggcggccatcgtgctgcgcagcctgggcgcttggggagccgcccacttcgccgggtcgcgccccgacggccggagcgtggatgcggcggcgcccgccgagccggggcggacgcggggcggcccgggcccgggagacgcgccggcagccccggcaccgcagcggtcgcaggatggccgaggctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacacc

SEQ ID NO: 3185 - DNA, 3187 bp, Homo sapiens
gtcggttccgtgctgggagccggagttcctcgggatttgtcagccagatgtgacaagattgtggcgaggcgagtgaaggagatctgatattaatcagcgcgtagctccgagccaaactttcacaaatgcggtgtagaaacatgttcttctcatttaaggcatctctttgtggctgcggggctgccaccgctccgagtctgacagctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgag

SEQ ID NO: 3186 - DNA, 2852 bp, Homo sapiens
gaggcccggaggaactcggagggggagggagagaaaggccgagacggagggagccagcggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagatactgggagaagagcaatgagcaaaacggtctccttgtatcatggggagagactctgtcaagcctaaagtga

SEQ ID NO: 3187 - DNA, 3393 bp, Homo sapiens
gagagaaaggccgagacggagggagccagcggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacact

SEQ ID NO: 3188 - DNA, 5941 bp, Homo sapiens
gcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaagaaaaaaacatggtcttgtttttactacctgttagatatagtgctaaagaggtgctggcatgctttacagcacagatctgattttttaaaatgtcctgtactagtacataaatcccgtcatgcactttttttcatacactacaaggggatgtgtaataaccatgcttcttttttatccttaaactattgccatacttcagtaagtgtcttttttaaaaaaaattcacttgtataaaaatggtctggtcagtatagggcacaaatgccaaacaaagtattagtgttaacacaaaactgccaactttgcacaagtttccagaaaagaaaatacaattagtcactcaacataaccacaggccaatttgttggccaccagaaaaccgctttttaaaaaaacacttggtgattctttcaagtgccgaatgttattagaatcaacattgcatccttcttgcttatacgttaagttacataaaaggaaaacaaaattatgtggtgtgaaacagccaaggcatttattcttcagaggcaggataatatttcaggatacaaaagcccaaattacccgctacggaacaaagatgaatacagtaaaagagtcgaacactcatttccaaggccctaacccttatcctttaaaaagaaatcctctgaactgggtcggtctgttgtatggctgtctaatttgttgcaaattctgcagtcgtactataattcaggcctgtttggtagacaaaatcaaaaggcatttaacagcagcagtacttggaagctttgaaaacatgtgctaaacttgaatggagcaacactcctttctgaaaagccagaagaagggggttttaaagcaggatctctcaatgttcagtgttttgtgtttccccacacgatttgtcagagagaaatgaaagcaagcctgaaaccaagcaattgagagtgagaaagaggagagagactattctccaaaccttttttgttttgttttgtttccgatgtttacacatgttgcctgagctggttaaccacatcggcagcctcagctaccacaacatactgactaaatgatgatatttactcaagttcagtctgcagccaaaaccattagggtgtgcattgcagactgttttgttgtcttttttttttcttttttcctttttttttaagtggaggggaaaagaagagataaacaaggaatattttgtcaaacagtacacaataatttaaagagaatgtatttcttttttgcatttaatggcctcagacatttctttcatcagtctaaaagttagaaatatccctttattttaacttttatgtcgtttccatttttcatgtttttgtaattattttttctatgttcacatcagcattcacttccgttaaatttgccaaaggaaactgttaatatgtttctgttgttattattcctgtaggatttattgtacctcacagtatttattgtttcccaaaataagcatcattagttggggattcagtatttttgttgtgaaaatttcagaaacaatagattcttaaagataagctagctatgtctaggagctttatcttttcacctccttcagaggatgctatggggtccattttaattcttcatttgttctacggggaggaaagaccaaaagtatttgcagtacaaaagaaactatatcaaacactatgttaaatgacaagtgtttatggtaaaaagctgaggaattagtaataatcgtttttgttttcttgtactttgaattccccaaagtcttaattgctttattttggtgttgtgttaaattgaacagacagatgttttcctttgttttataccatataagactctgtacagtatgtttgtgaaagattgaactagaataatgaaagtttgtttgcaaa

SEQ ID NO: 3189 - DNA, 2106 bp, Homo sapiens
ccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctccgaagaggaaattctaaccggcctggaacctgctgtcttcatacgggagattctcttgaagagagcgtgatagtcagaattagctgcaaaagattagaaagctgatcttattgtcacaagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaa

SEQ ID NO: 3190 - DNA, 3673 bp, Homo sapiens
tcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctcctgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaa

SEQ ID NO: 3191 - DNA, 3814 bp, Homo sapiens
acttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggttccattggcatgtactggcagagtgctgggggcagacttctgcccaaacctggaggagccataccacaggctggaagtccaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgc

SEQ ID NO: 3192 - DNA, 361 bp, Homo sapiens
ggacttttttgttgcattatttaggttgccacatatagtggggatgacagtttgtagatgtgcaggttactggttccattggcatgtactggcagagtgctgggggcagacttctgcccaaacctggaggagccataccacaggctggaagtccaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatggga

SEQ ID NO: 3193 - DNA, 3841 bp, Homo sapiens
acttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggctggtctcaaactcctgacctcaggtgatccacccgtcttggacttccaaagtgctgggattacaggcgtgagccactgcacccggctgaaagttgctatgatttctaaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgc

SEQ ID NO: 3194 - DNA, 4841 bp, Homo sapiens
gagagaaaggccgagacggagggagccagcggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagatactgggagaagagcaatgagcaaaacggtctccttgtatcatggggagagactctgtcaagcctaaagtgagcctcggatcttcctaatgacctcctgctggcccagctggatgcaagacaagctcgtttaagcctctgctgacctttcactcctccactacaagaactgcaccactcatttccaccgtcttcagaactgtgcaccaaatagaccacaaagcttcatggctgacgaatgatttccttttcatgatgcaaagagatttttacaaatttctattgatgagagttaacattaagtctcttgtggcattataacctctgttgcacaaatacaatgcttctatataactcttatttttaccttccttataaaggaacaatctactgttcttgccagcattatcttgaaaattcaggccaaaatatctgagcagaatgcacatactgagtgcaccggtggtatttttcatgaagagaccactttgaaagggtcttcctgatttccacctccctcagaatctatctgaccttctcacagactttattggtgtgaatctttcttatatttaaccatttatttgagatgctcatttttgtagcccatcttttctttttaaaaaacatgggctggtttctacccagaagagggtggtaagactgtacatgtacgttaacattcacttgtataactcagcaaaagattagaaagctgatcttattgtcacaagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaaga

SEQ ID NO: 3195 - DNA, 2849 bp, Homo sapiens
gaggcccggaggaactcggagggggagggagagaaaggccgagacggagggagccagcggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctccgtagcaca

SEQ ID NO: 3196 - DNA, 2481 bp, Homo sapiens
agtgtagtcactgctggtctgctggtaaggagtttcgtgggagggtgttgagaatgaaacacacagagctgtatcccgcttcgggtgaatgaatgggaggcaatatacaaaatagccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagcaaaagattagaaagctgatcttattgtcacaagacacagtgccaacataaacctacatcgtaaactgttgaccaaagaactcgatgacatgggcctggactcgtcgcagccctcccttagcaaggacctccgcgatgaatttttggtgaagatatatggtg

SEQ ID NO: 3197 - DNA, 3015 bp, Homo sapiens
atgactgatgacgtcaaagaaccttctagattttctcttctactggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattag

SEQ ID NO: 3198 - DNA, 15955 bp, Homo sapiens
gagccgagctgggagatggcggcggcagcggcggcgccgagagtgtgagcaccgcccgggagccgccggcccgggcgcagcgcgaccccgaccccgcccgcccgcctgcccgccatgggcaacgaggtcagcctggagggcggcgctggcgacgggccgctgccgcccggcggcgccggccccggcccgggccccggccccggccccggcgcaggaaagccgccttcagcaccggccggtggcggacagctccccgcggcgggagcagcgcggtcgaccgcggtaccaccggtccctggccccggccccggccccggtcccggccctggcccgggcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacggcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccagcaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcattctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggacagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccaggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcacctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgtgcactggggtggcactggagagccatggcagtcgtgagatattgtatgtgtatgcacatgatcatgtgtgtatgtgcgtgcgtgcgtgcgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaa

SEQ ID NO: 3199 - DNA, 2974 bp, Homo sapiens
aaaggattcatcctaaagttaaggatggttcagtaaatcggatggaagatgatgaaaaattaagcaattagaaaaaaactgtccttgtgtaatgtgtcaacatggaaacaggacataatgtaaacatcagaatcccttgctgtgattctggtttttgtggctctggttacattgtttttttgtgtgtgtttttttttttttttgctttcccgtttcttaaacattggcgttcccaagtttctccttggtcctcctgtcatttttatctactctcgtagcttcaaataccatctagtttatagtttatttagcatgttgtccaagccaccgtcttgggcccagggctctacctgtagcttttcatccacacttctcaggttgcttcttacacagcgccatagtagttaaaatacggtctggggatagtcgtctcttcatcagtctcccccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagcgacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttcttttttttttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagta

SEQ ID NO: 3200 - DNA, 2819 bp, Homo sapiens
tttttctttcaaaaatttgtttagtattgtagttaggctgtttgtgtgtatgcatgtgtatgtgtgtatgagtgcgtttgtgtgtgaccaaaacagtaactggcaaacgtaacaacaggaaattgtagggcagggtctgggaaaaggggaggaacccaaggtactgacaagcccagaccggactcccccgaagtgagcaggcagcaaaggctgagagtgccagctgcctgggcactgacggaccccacccacggaaacgatgccttatgaggaagctaacccgggccacttaccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagcgacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttcttttttttttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagta

SEQ ID NO: 3201 - DNA, 774 bp, Homo sapiens
ctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaagatggagccacgaacaacctctccagatcaaattcagatgagagtaatttctctgaaaaactgagggcatccactgtcatgtaccatccagaaggagaatccagcacgacgccctttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacac

SEQ ID NO: 3202 - DNA, 5942 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaag

SEQ ID NO: 3203 - DNA, 3959 bp, Homo sapiens
tttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 3204 - DNA, 2697 bp, Homo sapiens
tctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaaca

SEQ ID NO: 3205 - DNA, 2427 bp, Homo sapiens
tttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 3206 - DNA, 3805 bp, Homo sapiens
atgtcaaaaggcactgatgaagatattttctctggagtctccttctttctaacccggctctcccgatgtgaaccgagccgtcgtccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 3207 - DNA, 2291 bp, Homo sapiens
gcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaacccaagggggagctcagagaagagtccaggctgccagtgcaaaggtccagccctgtcgccaaggagaccctcagggaaatgcacaggcctccagctattcccacggcccctgtagctgagcgccagcttcttcctgggccaagctgaggctgtttcctgccgtgtccattctcctagcaacgcttctctttggccagtttgccatagtacctgagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcggagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgcta

SEQ ID NO: 3208 - DNA, 2660 bp, Homo sapiens
ggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctag

SEQ ID NO: 3209 - DNA, 7603 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 3210 - DNA, 7559 bp, Homo sapiens
tgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcagggccgtgcaggcctgcccagctgccagcggtggcccccatagctgcctcctcccaccctcactcatccgtgatcacttcacctctgcgtgccctgggcgctctcccgccctgcctccccctgccgtgctgcagcgcgcgcccggtctcgggtgacgggactcagggtgagggtcagacggaggctccctttggatgccagtgtcagttgtcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 3211 - DNA, 2038 bp, Homo sapiens
cgggcggggcgcagggcaggctgcacctcagagcggcgggagcagcggcgggtccaggaaacccctggggcgtacgggtggccccgggggggccgggggcggggaggcgggcggccggcaccgccccggccgacaaaagtcccttcagttcagccggctgcaggggaagtcccggcgcccggcgaaaccaccctcccgtgcagccgagcccagccgctctccggccgccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgccctgtggggtcaacccttctggaaactgtgaagatctcactctgccccccccccccatcttcgggaccaggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccata

SEQ ID NO: 3212 - DNA, 1714 bp, Homo sapiens
aaactgctccccgctcctgcagcaccggcctcggtcgcgctgactctggcctggtgtccgtgtctcttgctatctctctttctctcaagatctctgcgcctgtctccatgtctctttctctctgtgcacctaggattttccgagcacccaccccggtgccccgcgggccccggctgggggcagggcccccaacgagtgcagagacacaatcagtggagcgctccccaccctcaccccacccccagcccctttagacccacagctgatgaggcacgtggagtggcagagatggaagaggggagggagaggaatcgttcctggccgcctgccgagtgccagtccctgccccgggtgcgtctcttcactcccactaaggaggaaacggctcagagaggggaagtgtttggccaaggtcacccagcgagagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtgagccggggcagctgtggacatgccccttgcacacgtgtgtccgcgggctggttgcaggcgagtgtgccagagcgcagaggagtgagggtgtctgtgccgttgcgtggaggggagtgggtgagcctctgaaagcgcgggtgtgagttccagaaatgaggagagactggcaccaagaaaaaaagtgccttgcccatcttttcatactgagaagtggagaggccaccacctggatccagtgagctaggagggatgggagagaggactgtgaggcatgggtggctctatggtcacgcccatcttcctacaggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccct

SEQ ID NO: 3213 - DNA, 3525 bp, Homo sapiens
gagaccccgccccccttaagaagagaagccgcggcccctgcaggacgggggcctgtgtcgctatgggttcccccgccgccccggagggagcgctgggctacgtccgcgagttcactcgccactcctccgacgtgctgggcaacctcaacgagctgcgcctgcgcgggatcctcactgacgtcacgctgctggttggcgggcaacccctcagagcacacaaggcagttctcatcgcctgcagtggcttcttctattcaattttccggggccgtgcgggagtcggggtggacgtgctctctctgcccgggggtcccgaagcgagaggcttcgcccctctattggacttcatgtacacttcgcgcctgcgcctctctccagccactgcaccagcagtcctagcggccgccacctatttgcagatggagcacgtggtccaggcatgccaccgcttcatccaggccagctatgaacctctgggcatctccctgcgccccctggaagcagaacccccaacacccccaacggcccctccaccaggtagtcccaggcgctccgaaggacacccagacccacctactgaatctcgaagctgcagtcaaggcccccccagtccagccagccctgaccccaaggcctgcaactggaaaaagtacaagtacatcgtgctaaactctcaggcctcccaagcagggagcctggtcggggagagaagttctggtcaaccttgcccccaagccaggctccccagtggagacgaggcctccagcagcagcagcagcagcagcagcagcagtgaagaaggacccattcctggtccccagagcaggctctctccaactgctgccactgtgcagttcaaatgtggggctccagccagtaccccctacctcctcacatcccaggctcaagacacctctggatcaccctctgaacgggctcgtccactaccgggaagtgaatttttcagctgccagaactgtgaggctgtggcagggtgctcatcggggctggactccttggttcctggggacgaagacaaaccctataagtgtcagctgtgccggtcttcgttccgctacaagggcaaccttgccagtcatcgtacagtgcacacaggggaaaagccttaccactgctcaatctgcggagcccgttttaaccggccagcaaacctgaaaacgcacagccgcatccattcgggagagaagccgtataagtgtgagacgtgcggctcgcgctttgtacaggtggcacatctgcgggcgcacgtgctgatccacaccggggagaagccctacccttgccctacctgcggaacccgcttccgccacctgcagaccctcaagagccacgttcgcatccacaccggagagaagccttaccactgcgacccctgtggcctgcatttccggcacaagagtcaactgcggctgcatctgcgccagaaacacggagctgctaccaacaccaaagtgcactaccacattctcggggggccctagctgagcgcaggcccaggccccacttgcttcctgcgggtgggaaagctgcaggcccaggccttgcttccctatcaggcttgggcataggggtgtgccaggccactttggtatcagaaattgccaccctcttaatttctcactggggagagcaggggtggcagatcctggctagatctgcctctgttttgctggtcaaaacctcttccccacaagccagattgtttctgaggagagagctagctaggggctgggaaaggggagagattggagtcctggtctccctaagggaatagccctccacctgtggcccccattgcattcagtttatctgtaaatataatttattgaggcctttgggtggcaccggggccttcattcgattgcatttcccactcccctcttccacaagtgtgattaaaagtgaccagaaacacagaaggtgagatcacagctctgctggcagagattactagcccttggctctctcgtttggcttgggtattttatattatttctgtcataacttttatctttagaattgttctttctcctgtttgtttgcttgttagtttgtttaaaatggaaaaaggggttctctgtgttctgcccctgtaattctaggtctggaacctttatttgttctagggcagctctgggaacatgcgggattgtggaattgggtcaggaaccctctctggtattctggatgttgtaggttctctagcagtctagaaatggatacagacatttctctgttcttcaagggtgataggaaccattatgttgagcccaaaatggaagtaataataaatgcctcctggaggctgtgggtgtgggggattctgtatctggattccgtatcactccaagtggaggctggcaggtttttctgcaagatggtccagaatctaaaatgtcccattaatctggtcacttgggtttggctctgctgtatccatctatagtggtagagacccaccagggctcaagtggagtccatcatcctcccacgggggcctgttcttagcactgagttgatcgctccatgggggagagatcagacattccttatcagagatgatgtgaccttttctgactctgcccagtctctatgaatgttatggcctagggaagaatcatgaaactctttagcttgattagatggtaaacagtgttaacccatcctttactacagaggcatatgggtttgaatgttacctggggttctctctattgagttgagccccttcttcctttagtgggttttggacatcttctggcaagtgtccagatgccagaaccttcttttcctctagaagggatggtgcttggtaaccttaccttttaaaagctgggtctgtgacctggtcttcccatccctgcattcctgtctggaaccagtgaatgcattagaaccttccataggaaaagaaaaggggctgagttccattctgggtttgctgtagtttggttgggattattgttggcattacagatgtaaaagattgactagcccataggccaaaggcctgttctagttgaccaagtttcaagtaggattaagaggttggttgaggggtgcagtttctggtgtaggccaggtaggtagaaagtgaggaacagggttgcctcttggctgggtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgtgc

SEQ ID NO: 3214 - DNA, 475 bp, Homo sapiens
tgctcatcggggctggactccttggttcctggggacgaagacaaaccctataagtgtcagctgtgccggtcttcgttccgctacaagggcaaccttgccagtcatcgtacagtgcacacaggggaaaagccttaccactgctcaatctgcggagcccgttttaaccggccagcaaacctgaaaacgcacagccgcatccattcgggagagaagccgtataagtgtgagacgtgcggctcgcgctttgtacaggtggcacatctgcgggcgcacgtgctgatccacaccggggagaagccctacccttgccctacctgcggaacccgcttccgccacctgcagaccctcaagagccacgttcgcatccacaccggagagaagccttaccacgaaccagtgacttcatgaagtttctccggagccacctgcatcctgctgctctgaagtcacttcctgcctgaggtgtggaggctgc

SEQ ID NO: 3215 - DNA, 2581 bp, Homo sapiens
actgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggatttggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaa

SEQ ID NO: 3216 - DNA, 6245 bp, Homo sapiens
cccagcctagatttctttttattatgatcaaatacacataaaattgaccattgtaaccatttaaaagtgtacaattcagcgtcattaagtacattcacattgttctgcaaccatcaccactatctcattccagaactttcctatcactccgaaaggaaaccccacatccgttagcagtcactcctgctctccctcccccttgcctctggcaaccaccaatctgatatctgtctttatggattcgcctagttgtagatatctcccgcaaatggacttacgcatatttatccttttgtgactggcttctttcacttagcgtgtttcaaggttcacccatgttgtagcatgtattcattcccttttatggctgaataatattccattgtgtggatagacacatttatctgttcctcagtcactatttgaattctgacataatattttcctattttaaattttaagatacatttttttaaagtttcatgtggcccaaagcacatacctattgatctcacatatctctgtgagatctgttttatgacctgctgttgcatattttcccagaaaattctcggaacgattctctgaagtccttctttctctttctcttttttttctttttctttctctctttctttttttgttttgttttgttttattttgttttgttttgtttttttgagattcagttttgctctgttgcccaggctggagtgcaatggcatgatcattgcacctctgcctcccaggttcaagcattttcctgcctcagcctcccgcgtagctcagattacaggcctgcaccaccacgcccagctaatttttgtatttttagtagagacagggtttctccatgttggccaggctggtctcgaactcctgacctcgtgatctgcccacttcggcctccaaagtgctgggattacaggcatgaaccaccgcgcccggccttttttttttttctgagacagggtctcactctgtctcccaggctggagtgcagtggctggatctctgctcactgcaacctccgtctcccaggttcaagcgagtctcctgcctcagactcccgagtagctgcgattacaggagcccaccaccgcgcccggctaatttttgtatttttagtagagacggggtttcacccaccatgttggccaggctggtatcgaactcttaacctcaagtgatccacccgcctcggcctcccaaagtgctggtattacaggcatgagccaccgcgcccggccagtatttgttcttttcttcatttttcacgtcaggagactgcgtttcagaatagtaaaaacaaatgcctaggaaaaggcctgcggtctctccatttccacagtagcgtgttccccaaagaccaaaccctcaggggaaacgtctagaatgagtaacaacttaaggctgcaaccttaaactttcccaggactcagtttccccagctgtgaaatggctgctgtcgggctgtcatctccaggcccggggcgctgacatttgggccactctcggtctccctcttcattctgggcgcgcattagctctggtccggccggttccgctgcagctgaacagcaagatgcggcacccaggttaccctgatcatcgcagatttctccccggggctctgttctgaggcctcaaaagtgctccttgtagatgggaccaggggtcatttgggcagtagcagcgcctggtctcagtctggtactgaagtcaggaatggcttaaggtgaaatcgtggtcctctggtgaagctcagcgaagaccccctcgccttgtttatgacaagagaacttctgggggcgggaggaagagtccctgttacgatgctgatcatcattgagcttttgctgagcagaaaactctttagtactcaaggtcgagagtctctggtggtctgcctggcaccaggcaccttcctacaaccctagttttccaaaaggacaaagcctggggcaggcgacgtcctagctcgcatttgaacagggccgcgggccagcagagatgcgcgatgcccaactctttccaagagcacctcgcgtcccgaaccggtgccttcaactcggagaagtcaagagacccgcaagaaacttgcacgactgcacccgccgccgcgctctgggggctgggcaggggcagctgggctggctcccggggaacgcgacccccccgcgccccgcagaccggctgtctcccatggacccctcggcacctgcagcctccgaggaagggtcagcgcgcgtgtccgcacgcccgcccccaccgcgcgcccagagccgggggtcgccgtgcgcccttcgccacctccccaggagggcgtccggggcgtcccctctgggggcgcaggaggcccgggggcgctgcccggtggccgcggcgcccggaggccgcactgccggcggcggcggcggcgcggctccccctgctctgtgcagctgccgcccggcgcttgcgcactgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggtacctcgctcgaggtctcagaggggcagccagatcggccgggagcccattgggttgtcgggggatttggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaaccacaactttgaaaatcttaatgttgaagttagcaatgccgaaaggtttctgtcttaaaaaaaaaaatccttgtacttatcaattttgccccttaggcagtcagttttgttgagaactgtgtcctgcatcctggcgcagaacctacctgatgcggttcctctccacgcatctcgaggcggcgttacctccagattccgtagagttagagtcacatttttctttgcagcgaaactccatcttggtgagagatgaatttggatatttatttccttctctgtttttgggaaacgagaggctacaaccaagacagctgaaggagaatgaaacacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctccccccaccacagaatctaagacctttcagcttcgagccagggggcgggggatcccgagcaaaagccttccgtggacatcaggccccgtggcctcaagggctcccagggcaaacctaattccccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattccatcagtagatatggtttgtacaatgtacaattgtttcatttcagaaaataaaaatttcaaatcatg

SEQ ID NO: 3217 - DNA, 1975 bp, Homo sapiens
ggaggacagagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatg

SEQ ID NO: 3218 - DNA, 1458 bp, Homo sapiens
tgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaa

SEQ ID NO: 3219 - DNA, 953 bp, Homo sapiens
ctctggccgcccgcgccaccgggccgctccggggacaggccggggcggggcgcggcggcaggaaacggggcggggacttgcggaggcgttggggacgagagagggcgcggccaactccaggggggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaa

SEQ ID NO: 3220 - DNA, 1983 bp, Homo sapiens
tccgtccccaactcgcgcgtccgtccccaactcccgctctcggcggcgggcagggggcgctgagcgtccaggcgctccaagggggcgggcccgggtcggggcggggccggccgggcttccaggcctgggctctggccgcccgcgccaccgggccgctccggggacaggccggggcggggcgcggcggcaggaaacggggcggggacttgcggaggcgttggggacgagagagggcgcggccaactccaggggggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggattcgggagtgagaatgacgaggagagcccttcacgagaaggggctgaagacagagcccctcaggaggctcctgcccaggaggggcctccggacaaatgtccggcccagttccatggcggtgccggacaccagagctcccgggggaggcagcaaggccccgagggcacccagaacaatcccccagggtaaggggaggtgagtgggctccccaagcaagccaagacccctaaagcctcccttggctgccccaagatccagccactacctgtgccccgagggcggaaagagcttcccagctcacccaccgcggtaacatcggagggcgagcggccccacacctgcccgaacctaaggccacagcacccatctggctcgccactggcgcccgaatgcatgggaagggcttagggcagaactcggaccacatccagtgcctgaggccgccttgctagaggcctaggggaggggtgcactgggctgcctcgcccacctcctcacgcacccatgcggccaccctcccagcggtctgagtgtgccatgcgaggcgcctgccaccccgggagaggcgccgagtcccgagtcctgccggcactgagcctccgggtccacagcgggcaagggccgtggcggggacaagcgcaggggacccgccggcctcccgccttctgcagcaccacgagatgcccacgtggcacctggacgtccatgcatatgttgaggcccgtgcacgcgcagagaccccagcgcagaagccgccccgcacgccagggcttatgtatgccagcgctgggagacctccagcgcccgaggacatacggcaagtggttccaccagggtgtcagcctagcaggccaacctgggaacccatgtggacaagcggcctttcagcccaggcgcccgcctcgggtggaggcgtggagacttctggcgcagccctgagctggtggcctaacctacctggaaaatcctagcccgagaagcagcgcgagtgagccttttgggtggttccaaggcccttcaccaagctctcacttcctgacttcaccgttgggtctgttgtactaggaaataataacgcctcccatttatcaaggg

SEQ ID NO: 3221 - DNA, 6278 bp, Homo sapiens
cttccatgtgtgaaagctacttggcatgaatgcctgggccgtaccaagtgtcaccgcagcaagagggggagtcagaagaaaaacagatcagaccagagcagacaataggcccctaaagtgttccccctaagttgctttgatgttgtcctggtgtcttgataccaggaggccagggattgcaggaaaagggtcttttttgtcttcattcactttcccccctcagtttctgaaatgattctccagaatttctcctcataaaaaaggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagcaggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgaggcagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattctggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttcttacaaaa

SEQ ID NO: 3222 - DNA, 10005 bp, Homo sapiens
cgtgcgtgtcttgtctccctgtccacgtgtgagctgtgagtgtgtgtgagtcagagttcgggtgtctgtgggtctctgagcctctgctggcagcacccggggctcgccaagctcttgccggctggcgcgcgcccagcccctggcgggacttgtccgtgtgtctgtccgcgcgcggggcctggagaagcacgctgcagtcctgtccgcctcccgctcgctgcctcgctggctgtcgctcgctcgctctgcctctccgcccgggctctgccgaagggggcggggtgggggtgcagggcggggggaggggaggctcctgcattcttgcggtcggggaggaatccgagccagcgttactggtctccagaagagcccagctgcagccccggggccccgccaggcctctcgctgcccgcccgggcctgctgggatgggcacgggctaggcctcgagctggggacggggcggggcgtggccccaaccccgggccccctccacggctggagcgctctgggggtggggcacgaggggtaccccaccctgggtgaggggcgcgtctgggagcaggaatccctcagggggccaggggagacctcacagccgccccacacggcacctttgctacctagccttttagtgaattctgtctctgccgcccgtcggggcggaggcttgctggagactgcaagccccctgagggcaaggtgcgggagggatggggacagggctggcctccaggatcgagaccccatctcgtaatcctctttttccagtgccaccccaccctatccagctccctagtcccagggctgttgggtcctcccttctcccctccccctctgacaccccctccccaagtcacgagttttctctttggggcttgttgctgcagtccgtgctccagtaccgagtacctggctgggccctgggcacgcacaggggccgtagccccactgtgtgtgggagccatgaggatcctggctaacaagacaaggttaccccaccccaggaggagagaagctccagggagcccgccgctgtccccccgcggtcattgcccccctgccccagccaagccaatgcacccagaaaataaattgaccaatcatggcaagacagggaatggcggggcccaatctcagcaccagaatgtgaaccaaggacccacctgcaacgtgggctcgaagggcgtgggggcggggaaccatggggccaaggccaaccagatctcgcctagcaactcaagtctgaagaacccccaggcaggggtgccccctttcagctcgctcaagggcaaggtgaagagggaccggagtgtgtctgtggactctggagagcagcgagaggctgggaccccatccctggattcagaggccaaagaggtggcgccgcggagtaagcggcgctgtgtgctggagcggaagcagccgtacagtggggacgaatggtgctctggaccggacagtgaggaggacgacaagcccattggggccacccacaattgtaatgtagcagacccagccatggcggccccacagctgggtcccggccaaaccacccaactgcccctcagcgagagcagcgtgccaggcgccccgcacggccctcctcctggccttcggcctgatgcccctgggggcgggggcgggggcgggggcgtccccggaaagcctccctcgcagttcgtatatgtcttcaccacccacctggccaacacggctgcagaggcagtgctgcagggccgggccgactccatcctcgcctaccaccagcagaacgtgccccgggccaagcttgaccaggcccctaaagtgccccccaccccagaaccgctacccctgagcacgccgtcagcaggcaccccgcagtcccagccacctccactgccgccgccgccacccccggcccctggcagtgccccgcctgctctgcccccagaggggcctcctgaggacagcagtcaggacctggcccccaactcggtgggagctgccagcacaggtggtgggactgggggcacccaccctaacaccccgacggctaccaccgccaacaaccctctgcctcctggaggagaccccagcagtgcccccggccctgccctgctgggggaggcagccgcccctggaaatgggcagcgcagcctggtgggctcagagggcttgtccaaagagcagctggagcatcgggaacggtccctccagacgctgcgagacattgagcgactgctgctccgcagcggagagactgagcccttcctcaaggggcccccaggaggagcgggtgaggggggcccaccagcacaagccccccctcccccccagcagccacccacggcccctcccagcgggctgaagaaatatgaggaacccttgcagtccatgatttcacagacacagagcctagggggccccccgctggagcatgaagtgcctgggcaccccccgggtggggacatggggcagcagatgaacatgatgatacagaggctgggccaggacagcctcacgcctgagcaggtggcctggcgcaagctgcaggaggagtactacgaagagaaacggcggaaagaggaacagattgggctgcatgggagccgtcctctgcaggacatgatgggcatggggggcatgatggtgagggggcccccgcctccttaccacagcaagcctggggatcagtggccacctggaatgggtgcgcagctgcgggggcccatggatgttcaagatcccatgcagctccggggcggacctccctttcctgggccccgtttcccaggcaaccagatacaacgggtacctgggtttgggggcatgcagagtatgcccatggaggtgcccatgaatgccatgcagaggcccgtgagaccaggcatgggctggaccgaagacttgccccctatggggggacccagcaattttgcccagaacaccatgccctacccaggtgggcagggtgaggcggagcgattcatgactccccgggtccgtgaggagctgctgcggcaccagctgctggagaagcggtcgatgggcatgcagcgccccctgggcatggcaggcagtggcatgggacagagcatggagatggagcggatgatgcaggcgcaccgacagatggatcctgccatgtttcccgggcagatggctggtggtgagggcctggcgggcactcccatgggcatggagtttggtggaggccggggcctcctgagccctcccatggggcagtctgggctgagggaggtggacccacccatggggccaggcaacctcaacatgaacatgaatgtcaacatgaacatgaacatgaacctgaacgtgcagatgaccccgcagcagcagatgctgatgtcgcagaagatgcggggccctggggacttgatggggccccagggcctcagtcctgaggagatggcccgggttcgggcccagaacagcagtggcgtgatgggcggcccgcagaagatgctgatgccttcacagtttcccaaccagggccagcagggattctctggaggccagggaccctaccaagccatgtcccaggacatgggcaatacccaagacatgttcagccctgatcagagctcaatgcccatgagcaacgtgggcaccacccggctcagccacatgcctctgccccctgcgtccaatcctcctgggaccgtgcattcagccccaaaccgggggctaggcaggcggccttcggacctcaccatcagtattaatcagatgggctcaccgggcatggggcacttgaagtcgcccacccttagccaggtgcactcacccctggtcacctcgccctctgccaacctcaagtcaccccagactccctcacagatggtgcccttgccttctgccaacccgccaggacctctcaagtcgccccaggtcctcggctcctccctcagtgtccgttcacccactggctcgcccagcaggctcaagtctccttccatggcggtgccttctccaggctgggttgcctcacctaagacggccatgcccagcccgggggtctcccagaacaagcagccgcctctcaacatgaactcttccaccaccctgagcaacatggaacagggtaccctcccgcctagcggcccccggagcagctcctcagcacctcccgccaaccctcccagcggcctcatgaaccccagcctaccattcacttcctccccagaccccacaccttcccagaaccccctgtcactgatgatgacccagatgtccaagtacgccatgcccagctccaccccgctctaccacaatgccatcaagaccatcgccacctcagacgacgagctgctgcccgaccggcccctgctgccccccccaccaccaccgcagggctccgggccagggatcagcaacagccagcccagccagatgcacctgaactcagccgctgcccagagccctatgggcatgaacctgccaggccagcagcccctgtcccatgagcccccgcccgccatgctgccctcccccacccctctgggctccaacattccactgcatcccaacgcacaggggacaggggggccccctcaaaactccatgatgatggccccagggggccccgactccctgaatgccccctgtggcccagtgcccagctcctcccagatgatgcccttcccccctcggctgcagcagccccatggtgccatggcccccactgggggtgggggcggggggcctggcctgcagcagcactacccgtcaggcatggccctgcctcccgaggacctgcccaaccagccgccaggccccatgcctccccagcagcacctgatgggcaaagccatggctgggcgcatgggcgacgcatacccaccgggtgtgctccctggggtggcatcagtgctgaacgaccccgagctgagcgaggtgatccggcccaccccaacggggatccccgagttcgacttgtcgaggatcatcccctctgagaagccaagcagcaccctccagtacttccccaagagcgagaaccagccccccaaggctcagccccctaatctgcatctcatgaacctgcagaacatgatggcggagcagactccctctcggcctcccaacctcccaggccagcagggcgtccagcgggggctcaacatgtccatgtgccaccctggacagatgtccttgctgggcaggacaggcgtgcccccacagcaggggatggtgccccatggcctgcaccagggggtcatgtcccctccacaaggcctcatgacccagcagaatttcatgctgatgaagcagcggggcgtggggggcgaggtctacagccagccgccccacatgctctccccgcagggctccctcatgggccccccgccccagcagaacctcatggtgtcccacccccttcggcagcgcagtgtgtccctggacagccagatgggctacctcccggcaccaggcggcatggccaacctgcccttctagaagtcgctgccagggctggagccggggcaatgttgcaaatacgataaccttaacaaagttcttcccctcaatgttgggatggcctgggtcgcggggtggggtggagggggtgggagggggcttgtgtagggagtggcatttgtggaaaccagatgtgctggcagcttagggggaagtggcagtgtggggtgggggattttgcattggggttggttccatttcggccaccaggactgcccctcccccactcctcccaattcctatggagcctctctattttacctctttccgtgcatccctgcacccgccacacccccttcagctatgcttttggagtcctggatgggaatctggggggagagaggaaggacaggtcaggtctcccccagccccttctgctcctgtctcctcgtgtccgcattgctggagctccacctccctcttggtttctccgcacccgcccattttccttctgtctttacctgcttcgtatcctttccctgctgatgtggctgacccctctcccacccctccctgcaggcggctggccaggtgggcaggtgccagccggagctgtaaatagagcgctgcgcttttgtgctggtttgtgcgtgtgctgtatttctgtgttttgatagaagtcacacaaaaaaaaaaggataaaagaaacccttccccccttcttcaagttattgctccctccattcccctggacccagggacatgcagccctacatggccacccactgtttgcagtgtctctgggtccctaagggataccattcctgtctcgtccccaaatggtaagatgacgtaaatgacccactcctaaactgaggtcagaccacctaggcttccacctggtgagccctagcagggctgagacccccagggcggcagcctgtctgctgctgagtgattcagggagaacatgtgtgcacgtgcatgtgtgtttgcccacaccggtgacacggggccctggctttccactttggatgcccgggcatccgctgctgctacatcttagccagaacttgaagtcttttgtcccagtttgggatgaaggaaaggaggaagaggcggtggctgtgtggcccccttgagtggagccatggaaggggtggcatggtgccactggggcctgtggctgtagtagccctgggccaggtaacctccagggccctgacttttccagaggctgctgccacctacttcttatcaaagaagggggagaacagttcatctgagtcagtgcacctcccctccagtctccactccctgaggatggaatcggggaaacagcatcctgccgcctcctctctgcctgcccactcaccggcaaggttgtccctctgcccagggctcagggccatgtaccagatctgtctgtgcccacccaggcacagccactgcctcccccttggctccctgctcctacccaggagagctccctatccgcctttggtcagagctgaagccatatacgactgggtgtttgtccccctactttggccccaggagtaaaaaaacttctccttttctcacttcctttcctgcctcgggaggtggcagggcagttccctggctgaggccttttgcgccccacctccaggaccaagggccattctagacagggtgtcttctaccaggacccgtccctagccttcctggcctggagggcctggtcttgcactggcagctgtaatacaaagggaactcgccccacttctcccagcctggtgctgtcctctcggcccaccatcggccaggtccagcgcttcctctggggctgacaacaggcccctgactcaccccggtcacctcccagggtccatggccagggcctctgtgtttggggggccacttgcccttcatcctgccaggcgctttgcccgccctgcctcagcctgggccctgtgcccttgagccctccacccctggcccaagacccccccaaactgtctgactctgtgtttcctgccctgaggagagaggggtcagattgcagcgggccgagtgccctctccgtcccctctcctcccacccacgccacaggccagcctactcttccctccatccatggccacacccccagccattttgtaccattatataaatatatatataaatataaatatataaatacaatatgtgaagacatcttcttggtttttattttgaaacaatttttaggcttgttccgggggtctctgtgctgcctgtactgtattgacctgttttataggtgcctttttattaaaaagaaaattcaaaatccagcctcttgcctctttgcatctgcttcagactcccccatcgattacccagcttgcgaggagatactcagagaaaaaagggacgtcttagggcttcctcgttgtcctgccgtgaagacactctcacgtgagccacagctgttatttccccagtggggcctcccaaggagcttggctgcttggcttgagtgggacaagggcaggggtccctgactccccacctgatcaaaggctggggaggtggtagggagcacccagaactgccggacgggcctcccacaccccaggtgagcaaacaagcacggagcagcttcctgcggttccatctgagtgacatcctcacgggggcagggcacggcttcctggggcctggggacttccctgcctcagtgtgtttcttacacttccctgcctaaggtgatgccacggaggggatggttgagatgactcccacgggccccttccagtccacctttctccgttccgactctgagtttcctcgggtctatagcttatgggaagggagtgaggaggggacaagccagcctccttccccatcaatgcccacaacctcccatcccctggacccagccaccctaggagttctccaccccaccccatctcgcctggcggaggggaccgccgggtttgattgatccatctccctccttggggttcgggaagaaagctcttttcttccctctgtcgggtttctttcttgcttctcggccttcacgcttcctcaggtcactggctggcctccaagggcacctagagtcagccctgcctgcagaccacccaggatccggtgacatggggtggacccagcgctgtttcggtcagagccaggggcagctacctgaactcaaccagtctgagcttcctgcttggtcaagatgactgcaggcttgggggcctggcagaatgtctgtgtttttagggactgagttgtccgaaggccacactctgctgccagctggcctttcctcagccttaacctccactcatcccctggtgctcagcttctggctttgtttgacaggtgggcaggaggagagaggggaagctgtggaggtcagcagcccctaagctgatggagtgtgttctgggaggggcaggcgctctccgttggcaagggcagaagtagaagttgtttcttgagcattggatgattaggatgggaggtgcgtgaggttctctcagcccaggggggtgcagatgggtaaggacagccttcactgtgcctttgagctgctttccgctccctgggctccagcctagccccagggccggcagaagagctggcagggatgttctagaaatgggggttggttcctctagctaccccaaatgaggatactcctaggacactcttagccacggtgagcccttaggatcccagctcctgttggaaggagcatccagcatcactgcctgccccaaggaaaagcagcaataaaaggggacactgggacctagaacgtggtgagagaggtggcattctctgactcagagagactgctcctgcgccagctagggaagagctggcacagggaggcagggccggtacagcccagcttcgtcaggagccgcgacaggtcactgcggaacttcacgccggcgaaagtgtagagcatggggttgaggcagcagtgggccaggcccaggaactcacacatggtgatggccacggggagagagccattcagcttgcaggtattgtccacggccttcagcctcgccagggtgtccaggaagatgacgatgtggtagggtgaccagcagaggaagaagatgcttgtcaccaggatggccaccctgactgccttctgccgctgagggcgccgctgggcctggcgcaacctgtgcactacccccacgtagcaccagcccatcaccagcatgggcagcaggaatcccgccacatggtagaggaatcgggaggtgaaccaggcatgcgtttctgcttggttctcttgggagaaggtgcaacgtggcagggagttgttgtgatggccttggctgactttggcgaagagaatctctggcaaggcaaggaggaagcccaccagccagatggtcccacaggtgatgtggatggagaggaggcggcggtggcggtaggcatggacggcgtggacaatggccaggtagcggtccacggcgatgcaggccaggagcaggctgctgcagtagaagttgactttgtgcagggcaatcacagttttgcagaggaaggtccccaggacccagcccacagagcc

SEQ ID NO: 3223 - DNA, 5153 bp, Homo sapiens
cgtgcgtgtcttgtctccctgtccacgtgtgagctgtgagtgtgtgtgagtcagagttcgggtgtctgtgggtctctgagcctctgctggcagcacccggggctcgccaagctcttgccggctggcgcgcgcccagcccctggcgggacttgtccgtgtgtctgtccgcgcgcggggcctggagaagcacgctgcagtcctgtccgcctcccgctcgctgcctcgctggctgtcgctcgctcgctctgcctctccgcccgggctctgccgaagggggcggggtgggggtgcagggcggggggaggggaggctcctgcattcttgcggtcggggaggaatccgagccagcgttactggtctccagaagagcccagctgcagccccggggccccgccaggcctctcgctgcccgcccgggcctgctgggatgggcacgggctaggcctcgagctggggacggggcggggcgtggccccaaccccgggccccctccacggctggagcgctctgggggtggggcacgaggggtaccccaccctgggtgaggggcgcgtctgggagcaggaatccctcagggggccaggggagacctcacagccgccccacacggcacctttgctacctagccttttagtgaattctgtctctgccgcccgtcggggcggaggcttgctggagactgcaagccccctgagggcaaggtgcgggagggatggggacagggctggcctccaggatcgagaccccatctcgtaatcctctttttccagtgccaccccaccctatccagctccctagtcccagggctgttgggtcctcccttctcccctccccctctgacaccccctccccaagtcacgagttttctctttggggcttgttgctgcagtccgtgctccagtaccgagtacctggctgggccctgggcacgcacaggggccgtagccccactgtgtgtgggagccatgaggatcctggctaacaagacaaggttaccccaccccaggaggagagaagctccagggagcccgccgctgtccccccgcggtcattgcccccctgccccagccaagccaatgcacccagaaaataaattgaccaatcatggcaagacagggaatggcggggcccaatctcagcaccagaatgtgaaccaaggacccacctgcaacgtgggctcgaagggcgtgggggcggggaaccatggggccaaggccaaccagatctcgcctagcaactcaagtctgaagaacccccaggcaggggtgccccctttcagctcgctcaagggcaaggtgaagagggaccggagtgtgtctgtggactctggagagcagcgagaggctgggaccccatccctggattcagaggccaaagaggtggcgccgcggagtaagcggcgctgtgtgctggagcggaagcagccgtacagtggggacgaatggtgctctggaccggacagtgaggaggacgacaagcccattggggccacccacaattgtaatgtagcagacccagccatggcggccccacagctgggtcccggccaaaccacccaactgcccctcagcgagagcagcgtgccaggcgccccgcacggccctcctcctggccttcggcctgatgcccctgggggcgggggcgggggcgggggcgtccccggaaagcctccctcgcagttcgtatatgtcttcaccacccacctggccaacacggctgcagaggcagtgctgcagggccgggccgactccatcctcgcctaccaccagcagaacgtgccccgggccaagcttgaccaggcccctaaagtgccccccaccccagaaccgctacccctgagcacgccgtcagcaggcaccccgcagtcccagccacctccactgccgccgccgccacccccggcccctggcagtgccccgcctgctctgcccccagaggggcctcctgaggacagcagtcaggacctggcccccaactcggtgggagctgccagcacaggtggtgggactgggggcacccaccctaacaccccgacggctaccaccgccaacaaccctctgcctcctggaggagaccccagcagtgcccccggccctgccctgctgggggaggcagccgcccctggaaatgggcagcgcagcctggtgggctcagagggcttgtccaaagagcagctggagcatcgggaacggtccctccagacgctgcgagacattgagcgactgctgctccgcagcggagagactgagcccttcctcaaggggcccccaggaggagcgggtgaggggggcccaccagcacaagccccccctcccccccagcagccacccacggcccctcccagcgggctgaagaaatatgaggaacccttgcagtccatgatttcacagacacagagcctagggggccccccgctggagcatgaagtgcctgggcaccccccgggtggggacatggggcagcagatgaacatgatgatacagaggctgggccaggacagcctcacgcctgagcaggtggcctggcgcaagctgcaggaggagtactacgaagagaaacggcggaaagaggaacagattgggctgcatgggagccgtcctctgcaggacatgatgggcatggggggcatgatggtgagggggcccccgcctccttaccacagcaagcctggggatcagtggccacctggaatgggtgcgcagctgcgggggcccatggatgttcaagatcccatgcagctccggggcggacctccctttcctgggccccgtttcccaggcaaccagatacaacgggtacctgggtttgggggcatgcagagtatgcccatggaggtgcccatgaatgccatgcagaggcccgtgagaccaggcatgggctggaccgaagacttgccccctatggggggacccagcaattttgcccagaacaccatgccctacccaggtgggcagggtgaggcggagcgattcatgactccccgggtccgtgaggagctgctgcggcaccagctgctggagaagcggtcgatgggcatgcagcgccccctgggcatggcaggcagtggcatgggacagagcatggagatggagcggatgatgcaggcgcaccgacagatggatcctgccatgtttcccgggcagatggctggtggtgagggcctggcgggcactcccatgggcatggagtttggtggaggccggggcctcctgagccctcccatggggcagtctgggctgagggaggtggacccacccatggggccaggcaacctcaacatgaacatgaatgtcaacatgaacatgaacatgaacctgaacgtgcagatgaccccgcagcagcagatgctgatgtcgcagaagatgcggggccctggggacttgatggggccccagggcctcagtcctgaggagatggcccgggttcgggcccagaacagcagtggcgtgatgggcggcccgcagaagatgctgatgccttcacagtttcccaaccagggccagcagggattctctggaggccagggaccctaccaagccatgtcccaggacatgggcaatacccaagacatgttcagccctgatcagagctcaatgcccatgagcaacgtgggcaccacccggctcagccacatgcctctgccccctgcgtccaatcctcctgggaccgtgcattcagccccaaaccgggggctaggcaggcggccttcggacctcaccatcagtattaatcagatgggctcaccgggcatggggcacttgaagtcgcccacccttagccaggtgcactcacccctggtcacctcgccctctgccaacctcaagtcaccccagactccctcacagatggtgcccttgccttctgccaacccgccaggacctctcaagtcgccccaggtcctcggctcctccctcagtgtccgttcacccactggctcgcccagcaggctcaagtctccttccatggcggtgccttctccaggctgggttgcctcacctaagacggccatgcccagcccgggggtctcccagaacaagcagccgcctctcaacatgaactcttccaccaccctgagcaacatggaacagggtaccctcccgcctagcggcccccggagcagctcctcagcacctcccgccaaccctcccagcggcctcatgaaccccagcctaccattcacttcctccccagaccccacaccttcccagaaccccctgtcactgatgatgacccagatgtccaagtacgccatgcccagctccaccccgctctaccacaatgccatcaagaccatcgccacctcagacgacgagctgctgcccgaccggcccctgctgccccccccaccaccaccgcagggctccgggccagggatcagcaacagccagcccagccagatgcacctgaactcagccgctgcccagagccctatgggcatgaacctgccaggccagcagcccctgtcccatgagcccccgcccgccatgctgccctcccccacccctctgggctccaacattccactgcatcccaacgcacaggggacaggggggccccctcaaaactccatgatgatggccccagggggccccgactccctgaatgccccctgtggcccagtgcccagctcctcccagatgatgcccttcccccctcggctgcagcagccccatggtgccatggcccccactgggggtgggggcggggggcctggcctgcagcagcactacccgtcaggcatggccctgcctcccgaggacctgcccaaccagccgccaggccccatgcctccccagcagcacctgatgggcaaagccatggctgggcgcatgggcgacgcatacccaccgggtgtgctccctggggtggcatcagtgctgaacgaccccgagctgagcgaggtgatccggcccaccccaacggggatccccgagttcgacttgtcgaggatcatcccctctgagtttctccgcacccgcccattttccttctgtctttacctgcttcgtatcctttccctgctgatgtggctgacccctctcccacccctccctgcaggcggctggccaggtgggcaggtgccagccggagctgtaaatagagcgctgcgcttttgtgctggtttgtgcgtgtgctgtatttctgtgttttga

SEQ ID NO: 3224 - DNA, 5330 bp, Homo sapiens
cgtgcgtgtcttgtctccctgtccacgtgtgagctgtgagtgtgtgtgagtcagagttcgggtgtctgtgggtctctgagcctctgctggcagcacccggggctcgccaagctcttgccggctggcgcgcgcccagcccctggcgggacttgtccgtgtgtctgtccgcgcgcggggcctggagaagcacgctgcagtcctgtccgcctcccgctcgctgcctcgctggctgtcgctcgctcgctctgcctctccgcccgggctctgccgaagggggcggggtgggggtgcagggcggggggaggggaggctcctgcattcttgcggtcggggaggaatccgagccagcgttactggtctccagaagagcccagctgcagccccggggccccgccaggcctctcgctgcccgcccgggcctgctgggatgggcacgggctaggcctcgagctggggacggggcggggcgtggccccaaccccgggccccctccacggctggagcgctctgggggtggggcacgaggggtaccccaccctgggtgaggggcgcgtctgggagcaggaatccctcagggggccaggggagacctcacagccgccccacacggcacctttgctacctagccttttagtgaattctgtctctgccgcccgtcggggcggaggcttgctggagactgcaagccccctgagggcaaggtgcgggagggatggggacagggctggcctccaggatcgagaccccatctcgtaatcctctttttccagtgccaccccaccctatccagctccctagtcccagggctgttgggtcctcccttctcccctccccctctgacaccccctccccaagtcacgagttttctctttggggcttgttgctgcagtccgtgctccagtaccgagtacctggctgggccctgggcacgcacaggggccgtagccccactgtgtgtgggagccatgaggatcctggctaacaagacaaggttaccccaccccaggaggagagaagctccagggagcccgccgctgtccccccgcggtcattgcccccctgccccagccaagccaatgcacccagaaaataaattgaccaatcatggcaagacagggaatggcggggcccaatctcagcaccagaatgtgaaccaaggacccacctgcaacgtgggctcgaagggcgtgggggcggggaaccatggggccaaggccaaccagatctcgcctagcaactcaagtctgaagaacccccaggcaggggtgccccctttcagctcgctcaagggcaaggtgaagagggaccggagtgtgtctgtggactctggagagcagcgagaggctgggaccccatccctggattcagaggccaaagaggtggcgccgcggagtaagcggcgctgtgtgctggagcggaagcagccgtacagtggggacgaatggtgctctggaccggacagtgaggaggacgacaagcccattggggccacccacaattgtaatgtagcagacccagccatggcggccccacagctgggtcccggccaaaccacccaactgcccctcagcgagagcagcgtgccaggcgccccgcacggccctcctcctggccttcggcctgatgcccctgggggcgggggcgggggcgggggcgtccccggaaagcctccctcgcagttcgtatatgtcttcaccacccacctggccaacacggctgcagaggcagtgctgcagggccgggccgactccatcctcgcctaccaccagcagaacgtgccccgggccaagcttgaccaggcccctaaagtgccccccaccccagaaccgctacccctgagcacgccgtcagcaggcaccccgcagtcccagccacctccactgccgccgccgccacccccggcccctggcagtgccccgcctgctctgcccccagaggggcctcctgaggacagcagtcaggacctggcccccaactcggtgggagctgccagcacaggtggtgggactgggggcacccaccctaacaccccgacggctaccaccgccaacaaccctctgcctcctggaggagaccccagcagtgcccccggccctgccctgctgggggaggcagccgcccctggaaatgggcagcgcagcctggtgggctcagagggcttgtccaaagagcagctggagcatcgggaacggtccctccagacgctgcgagacattgagcgactgctgctccgcagcggagagactgagcccttcctcaaggggcccccaggaggagcgggtgaggggggcccaccagcacaagccccccctcccccccagcagccacccacggcccctcccagcgggctgaagaaatatgaggaacccttgcagtccatgatttcacagacacagagcctagggggccccccgctggagcatgaagtgcctgggcaccccccgggtggggacatggggcagcagatgaacatgatgatacagaggctgggccaggacagcctcacgcctgagcaggtggcctggcgcaagctgcaggaggagtactacgaagagaaacggcggaaagaggaacagattgggctgcatgggagccgtcctctgcaggacatgatgggcatggggggcatgatggtgagggggcccccgcctccttaccacagcaagcctggggatcagtggccacctggaatgggtgcgcagctgcgggggcccatggatgttcaagatcccatgcagctccggggcggacctccctttcctgggccccgtttcccaggcaaccagatacaacgggtacctgggtttgggggcatgcagagtatgcccatggaggtgcccatgaatgccatgcagaggcccgtgagaccaggcatgggctggaccgaagacttgccccctatggggggacccagcaattttgcccagaacaccatgccctacccaggtgggcagggtgaggcggagcgattcatgactccccgggtccgtgaggagctgctgcggcaccagctgctggagaagcggtcgatgggcatgcagcgccccctgggcatggcaggcagtggcatgggacagagcatggagatggagcggatgatgcaggcgcaccgacagatggatcctgccatgtttcccgggcagatggctggtggtgagggcctggcgggcactcccatgggcatggagtttggtggaggccggggcctcctgagccctcccatggggcagtctgggctgagggaggtggacccacccatggggccaggcaacctcaacatgaacatgaatgtcaacatgaacatgaacatgaacctgaacgtgcagatgaccccgcagcagcagatgctgatgtcgcagaagatgcggggccctggggacttgatggggccccagggcctcagtcctgaggagatggcccgggttcgggcccagaacagcagtggcgtgatgggcggcccgcagaagatgctgatgccttcacagtttcccaaccagggccagcagggattctctggaggccagggaccctaccaagccatgtcccaggacatgggcaatacccaagacatgttcagccctgatcagagctcaatgcccatgagcaacgtgggcaccacccggctcagccacatgcctctgccccctgcgtccaatcctcctgggaccgtgcattcagccccaaaccgggggctaggcaggcggccttcggacctcaccatcagtattaatcagatgggctcaccgggcatggggcacttgaagtcgcccacccttagccaggtgcactcacccctggtcacctcgccctctgccaacctcaagtcaccccagactccctcacagatggtgcccttgccttctgccaacccgccaggacctctcaagtcgccccaggtcctcggctcctccctcagtgtccgttcacccactggctcgcccagcaggctcaagtctccttccatggcggtgccttctccaggctgggttgcctcacctaagacggccatgcccagcccgggggtctcccagaacaagcagccgcctctcaacatgaactcttccaccaccctgagcaacatggaacagggtaccctcccgcctagcggcccccggagcagctcctcagcacctcccgccaaccctcccagcggcctcatgaaccccagcctaccattcacttcctccccagaccccacaccttcccagaaccccctgtcactgatgatgacccagatgtccaagtacgccatgcccagctccaccccgctctaccacaatgccatcaagaccatcgccacctcagacgacgagctgctgcccgaccggcccctgctgccccccccaccaccaccgcagggctccgggccagggatcagcaacagccagcccagccagatgcacctgaactcagccgctgcccagagccctatgggcatgaacctgccaggccagcagcccctgtcccatgagcccccgcccgccatgctgccctcccccacccctctgggctccaacattccactgcatcccaacgcacaggggacaggggggccccctcaaaactccatgatgatggccccagggggccccgactccctgaatgccccctgtggcccagtgcccagctcctcccagatgatgcccttcccccctcggctgcagcagccccatggtgccatgatggctgggcgcatgggcgacgcatacccaccgggtgtgctccctggggtggcatcagtgctgaacgaccccgagctgagcgaggtgatccggcccaccccaacggggatccccgagttcgacttgtcgaggatcatcccctctgagaagccaagcagcaccctccagtacttccccaagagcgagaaccagccccccaaggctcagccccctaatctgcatctcatgaacctgcagaacatgatggcggagcagactccctctcggcctcccaacctcccaggccagcagggcgtccagcgggggctcaacatgtccatgtgccaccctggacagatgtccttgctgggcaggacaggcgtgcccccacagcaggggatggtgccccatggcctgcaccagggggtcatgtcccctccacaaggcctcatgacccagcagaatttcatgctgatgaagcagcggggcgtggggggcgaggtctacagccagccgccccacatgctctccccgcagggctccctcatgggccccccgccccagcagaacctcatggtgtcccacccccttcggcagcgcagtgtgtccctggacagccagatgggctacctcccggcaccaggcggcatggccaacctgcccttctag

SEQ ID NO: 3225 - DNA, 1784 bp, Homo sapiens
gcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 3226 - DNA, 1715 bp, Homo sapiens
gcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 3227 - DNA, 992 bp, Homo sapiens
aagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 3228 - DNA, 1002 bp, Homo sapiens
aagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaatactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 3229 - DNA, 1724 bp, Homo sapiens
aagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 3230 - DNA, 1659 bp, Homo sapiens
aagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 3231 - DNA, 1710 bp, Homo sapiens
aagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggacccacagcctccactgccctccaaacagtgggagacgagaaagctccagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 3232 - DNA, 1676 bp, Homo sapiens
aagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 3233 - DNA, 1344 bp, Homo sapiens
aagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatataggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 3234 - DNA, 3372 bp, Homo sapiens
aaaccaaagcggccttttgagaagggatgtaagagcaggcccctgagcagtttcacttcctctgggcgcccagcagagcggagccctggccttgcgggcatgagccccggggctgcgtttcctgagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacaatgctgccagcagcgccaggcaaggggcttgggagcccggaccccgccccctgcggcccagcgcccccaggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacctgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagcta

SEQ ID NO: 3235 - DNA, 3044 bp, Homo sapiens
aaaccaaagcggccttttgagaagggatgtaagagcaggcccctgagcagtttcacttcctctgggcgcccagcagagcggagccctggccttgcgggcatgagccccggggctgcgtttcctgagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacaatgctgccagcagcgccaggcaaggggcttgggagcccggaccccgccccctgcggcccagcgcccccagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagctatgtctgagtttttaaagtaaatttataagaattagccaataaaattgcttctcggccttttggctaagatc

SEQ ID NO: 3236 - DNA, 3141 bp, Homo sapiens
ctggccaacaagggctgcagaggatgcacacatcaggaagagggtgggggactacttgcttgctggttttgcttgcatctgatgagtagaaattcagcctattctttgttttggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacctgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagcta

SEQ ID NO: 3237 - DNA, 3544 bp, Homo sapiens
tttggtttctcttcaagaattaacaaaccacttactcttgaattctcttctagttaacacaggcatcactacttccaattgatctcaggatgtgggatcctcatacacattttgaacaaaatcctctgtttcagcaaggaattcatatttgcatatggtgaagatggtttctgaagtgagatcagaagtagagcttctaatgacccccagaagcactgagtgaccaagtgacatacctgccaggcccattgtgtccatcgctctcagagcagctggggattgtgcttggctcccagagctatggtgcaaaaggcggggtcgctagggccactcagggaaagagaacccagaaacatggcatgctgacaaaaggtagtctctgcttatccagcttcactttctgctgatttagttacccatggtcaactgccatctgaaaataggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacctgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagctatgtctgagtttttaaagtaaatttataagaattagccaataaaattgcttctcggccttttggctaagatcaa

SEQ ID NO: 3238 - DNA, 2115 bp, Homo sapiens
gagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacaatgctgccagcagcgccaggcaaggggcttgggagcccggaccccgccccctgcggcccagcgcccccagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaag

SEQ ID NO: 3239 - DNA, 2448 bp, Homo sapiens
acttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaag

SEQ ID NO: 3240 - DNA, 1018 bp, Homo sapiens
cctgaagggcctccaagggagacgcctagaagatggaggcccagattcttgagacgtttctctttctgatctagcaggagggacaaagagctcctccactccctcattccccaagaaggcccccagcctacccagtttccgtgaccattccgccctgggaaagcggcttcccagacctccttatctatttttcttgaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtatggtgagaaaaaccatccatttacagttgcttcttttaaaggcagatgggaggaatgggaactatatcaacaaatcagttatgccgttagtagagcctcatcagacgtttcctctggcacttcctgcgatgaagaaagttgtagcaaggaacctcgtgtcattcctaaagtcagcaatccgaagagtatttatcaggttgaaaacttgaaacagccctttcaatcttggttacaaatcccccgcaaaaagaatgtggtggacggccgtgttggcctcctgggaaacacttaccatggctcgcagaagcatcctaagtgttacaggcctgctatgcaccggctggacagaattttataacccacatctgggaatgaatttgcagcacctggtagaagaaggcaccttggaaggcactgccttgggcttccatggcaggaagatgagaagaaatcttcagggtgatttctggagcctgaaaagaataaaaaacaaaaccaaaccta

SEQ ID NO: 3241 - DNA, 754 bp, Homo sapiens
ccaagggagacgcctagaagatggaggcccagattcttgagacgtttctctttctgatctagcaggagggacaaagagctcctccactccctcattccccaagaaggcccccagcctacccagtttccgtgaccattccgccctgggaaagcggcttcccagttgaagtcacgaggagttctccaagaaaggtctgctggctgattcttcattgacctaccagtccctgctatcaaggacactagaacctccttatctatttttcttgaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtatggtgagaaaaaccatccatttacagttgcttcttttaaaggcagatgggaggaatgggaactatatcaacaaatcagttatgccgttagtagagcctcatcagacgtttcctctggcacttcctgcgatgaagaaagttgtagcaaggaacctcgtgtcattcctaa

SEQ ID NO: 3242 - DNA, 4288 bp, Homo sapiens
atggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatgcaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagc

SEQ ID NO: 3243 - DNA, 4687 bp, Homo sapiens
ggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaa

SEQ ID NO: 3244 - DNA, 4545 bp, Homo sapiens
attttcccaggtaccctgcatgcatatagctgctgattctactcctgctattgctcacaaccctcagagtcaaactttgtgaccggcctaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagc

SEQ ID NO: 3245 - DNA, 492 bp, Homo sapiens
atggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagagcaccagcagaaccaaaatcgtgtgtggtggcagatcctcctcttcctgcacaaccttgctttgaatggagaagagaacaggaacggggcaggccctaggtga

SEQ ID NO: 3246 - DNA, 505 bp, Homo sapiens
attttggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggtaccctgcatgcatatagctgctgattctactcctgctattgctcacaaccctcagagtcaaactttgtgaccggcctaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgac

SEQ ID NO: 3247 - DNA, 630 bp, Homo sapiens
attttggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatgcaccagcagaaccaaaatcgtgtgtggtggcagatcctcctcttcctgcacaaccttgctttgaatggagaagagaacaggaacggggcaggccctag

SEQ ID NO: 3248 - DNA, 490 bp, Homo sapiens
ggagtcgcgctgcgcacgggggcccgggaagggtttgggctgcggacgtctggggtgaccatgaagaactggggcgctggggtgagggaacggggtgcagaacccacagttgggtgcgctgctccaagagggaacttgggggtagcatttgggactcgaaggagttgggtccaggtaggcaggggaacctggggtgcactgctgagcagacctgggcgcccgagaacggcccagcctctgggtctgactttgggataggacaggagctgtggggcatcctgcctctctgcggagtctgaaggctcctctccttaacagctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgat

SEQ ID NO: 3249 - DNA, 747 bp, Homo sapiens
tagctgctgattctactcctgctattgctcacaaccctcagagtcaaactttgtgaccggcctaggtcagaaaacgtgatcaagaaaaagggtggttccaggcgggcccagggaagaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggac

SEQ ID NO: 3250 - DNA, 735 bp, Homo sapiens
gctgtcctaggattgctggcttttgtttttgctgctgagcctggagctcagctcagactgagaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttg

SEQ ID NO: 3251 - DNA, 1160 bp, Homo sapiens
ctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacact

SEQ ID NO: 3252 - DNA, 1607 bp, Homo sapiens
agtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggtaggtgatgtgactgtgtgactcctgtcatggcatgtcgtggggcgattctgggttgcagtgatttattcgtaacctgtttcctgaagtccagatcatcagttacagcttggtgcattttcacaaacacccacgtagtcactgttcaggtccagaaaccaccagcctgcagcccccaaaggccccagcacaggcgccctgtggtgctgctgtctggcctgacgagtctgcctgttgctcactgaatataaacggagtcaaagcagggcttcttaggtctgacctctttgtcctgtgtgtaggtgaaagcagtctcatttctgtgtagtactgtggcgggaatgcacccagctctgctgtaggtggagggtctcagttacctgctgtacttcctccagacaggactgttgttctagtaactctcagcaatgaaggaaccaatgcagtctccgactttactggcttgagtttcgctcttgttgcccaggctgagtgcaggggcgtgatctcggctcactgcagcctctgcctcctgggttcaagcgactctcctgcctcagcctcctgggtagctgggattacaggtgcccaccaccaggcctggctaatttttgtatttttaatagagacggggcttcgccacgttgcccaggctgatctcgaactcaagggatggctcacctcggcctccaaagtgctgggattacaggcgtgagccaccgcgcctggcctttcctggctgcttatactcactcaccctgcagaaaacacagagaccaggcaggcgccgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactg

SEQ ID NO: 3253 - DNA, 3779 bp, Homo sapiens
gggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3254 - DNA, 3755 bp, Homo sapiens
ggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 3255 - DNA, 3565 bp, Homo sapiens
gtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggc

SEQ ID NO: 3256 - DNA, 3751 bp, Homo sapiens
ggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3257 - DNA, 3644 bp, Homo sapiens
ggggaagtcgggggcggagccgcggggtggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3258 - DNA, 3656 bp, Homo sapiens
ggggaagtcgggggcggagccgcggggtggtgggtgggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 3259 - DNA, 3783 bp, Homo sapiens
gggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 3260 - DNA, 3881 bp, Homo sapiens
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctct

SEQ ID NO: 3261 - DNA, 736 bp, Homo sapiens
cccccacgacacctgcatgtggtccggcctatgtctcactacaccacccccatggtgctccagcaggcagccattcccatacagatcaatgtgggaaccactgtgaccatgacaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctg

SEQ ID NO: 3262 - DNA, 3779 bp, Homo sapiens
gggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3263 - DNA, 1051 bp, Homo sapiens
agtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcaccc

SEQ ID NO: 3264 - DNA, 714 bp, Homo sapiens
tcctcagctgagggggctcccccgccaggtccagctcccccgccagccaccagccacccgagggtcatccggatttcccaccagagtgtggaacccgtggtcatgatgcacatgaacattcaagggccactgtctctgtctccctgcccagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttg

SEQ ID NO: 3265 - DNA, 3635 bp, Homo sapiens
ggagccgcggggtggtgggtgtgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3266 - DNA, 747 bp, Homo sapiens
tgtttggctgtgggttagttgtgccgttctgctggaacaccgtgggaaggcagtagacgcgggcagtcagctagcaggtccgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtg

SEQ ID NO: 3267 - DNA, 880 bp, Homo sapiens
cgcagagtgtggggcgaccaccgctttcgcgttgtcccaggattttccgacctctggggcgcttgtcctgccgtgaccgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaa

SEQ ID NO: 3268 - DNA, 2407 bp, Homo sapiens
cgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaaagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgct

SEQ ID NO: 3269 - DNA, 3779 bp, Homo sapiens; identical to SEQ ID NO: 3262

SEQ ID NO: 3270 - DNA, 3644 bp, Homo sapiens
ggggaagtcgggggcggagccgcggggtggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3271 - DNA, 410 bp, Homo sapiens
gtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttag

SEQ ID NO: 3272 - DNA, 1051 bp, Homo sapiens; identical to SEQ ID NO: 3263

SEQ ID NO: 3273 - DNA, 766 bp, Homo sapiens
agaagggggatggggacagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaa

SEQ ID NO: 3274 - DNA, 807 bp, Homo sapiens
cagctccctaagccgtcgatctcctgccctttgtgtttctctccctgtgccccggaatcagaagggggatggggacaggtgtgaatgtgtgtgtgtgcaggagaaactttttaggtattggggcagggattaatgctagggagtctttcgggtacactctggtctgggcaacagcgggccttccttccttcgttcttctttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgccc

SEQ ID NO: 3275 - DNA, 654 bp, Homo sapiens
cggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctcccc

SEQ ID NO: 3276 - DNA, 766 bp, Homo sapiens; identical to SEQ ID NO: 3273

SEQ ID NO: 3277 - DNA, 3783 bp, Homo sapiens; identical to SEQ ID NO: 3259

SEQ ID NO: 3278 - DNA, 993 bp, Homo sapiens
gtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacc

SEQ ID NO: 3279 - DNA, 714 bp, Homo sapiens
tcctcagctgagggggctcccccgccaggtccagctcccccgccagccaccagccacccgagggtcatccggatttcccaccagagtgtggaacccgtggtcatgatgcacatgaacattcaagggccactgtctctgtctccctgcccagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttg

SEQ ID NO: 3280 - DNA, 859 bp, Homo sapiens
gggtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaa

SEQ ID NO: 3281 - DNA, 2407 bp, Homo sapiens
cgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaaagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgct

SEQ ID NO: 3282 - DNA, 544 bp, Homo sapiens
tttccgacctctggggcgcttgtcctgccgtgaccggtgatgacactagtctctgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattca

SEQ ID NO: 3283 - DNA, 680 bp, Homo sapiens
atagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttag

SEQ ID NO: 3284 - DNA, 714 bp, Homo sapiens; identical to SEQ ID NO: 3264

SEQ ID NO: 3285 - DNA, 3783 bp, Homo sapiens; identical to SEQ ID NO: 3259

SEQ ID NO: 3286 - DNA, 880 bp, Homo sapiens; identical to SEQ ID NO: 3267

SEQ ID NO: 3287 - DNA, 544 bp, Homo sapiens; identical to SEQ ID NO: 3282

SEQ ID NO: 3288 - DNA, 1056 bp, Homo sapiens
tgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaa

SEQ ID NO: 3289 - DNA, 859 bp, Homo sapiens; identical to SEQ ID NO: 3280

SEQ ID NO: 3290 - DNA, 1710 bp, Homo sapiens
tcgggggcggagccgcggggtggtgggtgggtgtgtgtgtgtgtgtgtgtgtgtgtgtgtgtgtgtttggctgtgggttagttgtgccgttctgctggaacaccgtgggaaggcagtagacgcgggcagtcagctagcaggtccgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 3291 - DNA, 844 bp, Homo sapiens
cggtcccccgggcgacagcggtggcggctcctcggggtgctcggctccctcccacctaggccggccccggcccgactcgccctcagaaactcactgtttggggctgcggactttctcgtcgtgccccacaaaaagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcc

SEQ ID NO: 3292 - DNA, 3648 bp, Homo sapiens
ggggaagtcgggggcggagccgcggggtggtgggtgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3293 - DNA, 880 bp, Homo sapiens; identical to SEQ ID NO: 3267

SEQ ID NO: 3294 - DNA, 513 bp, Homo sapiens
gtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3295 - DNA, 554 bp, Homo sapiens
tctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctc

SEQ ID NO: 3296 - DNA, 783 bp, Homo sapiens
atagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3297 - DNA, 807 bp, Homo sapiens
cagctccctaagccgtcgatctcctgccctttgtgtttctctccctgtgccccggaatcagaagggggatggggacaggtgtgaatgtgtgtgtgtgcaggagaaactttttaggtattggggcagggattaatgctagggagtctttcgggtacactctggtctgggcaacagcgggccctccttccttcgttcttctttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgccc

SEQ ID NO: 3298 - DNA, 747 bp, Homo sapiens
tgtttggctgtgggttagttgtgccgttctgctggaacaccgtgggaaggcagtagacgcgggcagtcagctagcaggtctgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtg

SEQ ID NO: 3299 - DNA, 844 bp, Homo sapiens; identical to SEQ ID NO: 3291

SEQ ID NO: 3300 - DNA, 1056 bp, Homo sapiens; identical to SEQ ID NO: 3288

SEQ ID NO: 3301 - DNA, 513 bp, Homo sapiens; identical to SEQ ID NO: 3294

SEQ ID NO: 3302 - DNA, 902 bp, Homo sapiens
tccctaagccgtcgatctcctgccctttgtgtttctctccctgtgccccggaatcagaagggggatggggacaggtgtgaatgtgtgtgtgtgcaggagaaactttttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaa

SEQ ID NO: 3303 - DNA, 2407 bp, Homo sapiens; identical to SEQ ID NO: 3281

SEQ ID NO: 3304 - DNA, 3751 bp, Homo sapiens
ggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 3305 - DNA, 807 bp, Homo sapiens; identical to SEQ ID NO: 3297

SEQ ID NO: 3306 - DNA, 859 bp, Homo sapiens
gtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaa

SEQ ID NO: 3307 - DNA, 807 bp, Homo sapiens; identical to SEQ ID NO: 3274

SEQ ID NO: 3308 - DNA, 1714 bp, Homo sapiens
tcgggggcggagccgcggggtggtgggtgggtgggtgtgtgtgtgtgtgtgtgtgtgtgtgtgtgtgtgtttggctgtgggttagttgtgccgttctgctggaacaccgtgggaaggcagtagacgcgggcagtcagctagcaggtccgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 3309 - DNA, 993 bp, Homo sapiens; identical to SEQ ID NO: 3278

SEQ ID NO: 3310 - DNA, 1051 bp, Homo sapiens; identical to SEQ ID NO: 3263

SEQ ID NO: 3311 - DNA, 880 bp, Homo sapiens; identical to SEQ ID NO: 3267

SEQ ID NO: 3312 - DNA, 714 bp, Homo sapiens; identical to SEQ ID NO: 3279

SEQ ID NO: 3313 - DNA, 766 bp, Homo sapiens; identical to SEQ ID NO: 3273

SEQ ID NO: 3314 - DNA, 654 bp, Homo sapiens; identical to SEQ ID NO: 3275

SEQ ID NO: 3315 - DNA, 859 bp, Homo sapiens; identical to SEQ ID NO: 3306

SEQ ID NO: 3316 - DNA, 902 bp, Homo sapiens; identical to SEQ ID NO: 3302

SEQ ID NO: 3317 - DNA, 554 bp, Homo sapiens; identical to SEQ ID NO: 3295

SEQ ID NO: 3318 - DNA, 654 bp, Homo sapiens; identical to SEQ ID NO: 3275

SEQ ID NO: 3319 - DNA, 766 bp, Homo sapiens; identical to SEQ ID NO: 3273

SEQ ID NO: 3320 - DNA, 1689 bp, Homo sapiens
ggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtccgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 3321 - DNA, 714 bp, Homo sapiens; identical to SEQ ID NO: 3264

SEQ ID NO: 3322 - DNA, 747 bp, Homo sapiens; identical to SEQ ID NO: 3298

SEQ ID NO: 3323 - DNA, 544 bp, Homo sapiens; identical to SEQ ID NO: 3282

SEQ ID NO: 3324 - DNA, 844 bp, Homo sapiens; identical to SEQ ID NO: 3291

SEQ ID NO: 3325 - DNA, 902 bp, Homo sapiens; identical to SEQ ID NO: 3302

SEQ ID NO: 3326 - DNA, 410 bp, Homo sapiens; identical to SEQ ID NO: 3271

SEQ ID NO: 3327 - DNA, 766 bp, Homo sapiens; identical to SEQ ID NO: 3273

SEQ ID NO: 3328 - DNA, 3779 bp, Homo sapiens; identical to SEQ ID NO: 3262

SEQ ID NO: 3329 - DNA, 513 bp, Homo sapiens; identical to SEQ ID NO: 3294

SEQ ID NO: 3330 - DNA, 747 bp, Homo sapiens; identical to SEQ ID NO: 3266

SEQ ID NO: 3331 - DNA, 807 bp, Homo sapiens
cagctccctaagccgtcgatctcctgccctttgtgtttctctccctgtgccccggaatcagaagggggatggggacaggtgtgaatgtgtgtgtgtgcaggagatactttttaggtattggggcagggattaatgctagggagtctttcgggtacactctggtctgggcaacagcgggccttccttccttcgttcttctttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgccc

SEQ ID NO: 3332 - DNA, 1710 bp, Homo sapiens
tcgggggcggagccgcggggtggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtctgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 3333 - DNA, 736 bp, Homo sapiens
cccccacgacacctgcatgtggtccggcctatgtctcactacaccacccccatggtgctccagcaggcagccattcccatacagatcaatgtgggaaccactgtgaccatgacaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctg

SEQ ID NO: 3334 - DNA, 736 bp, Homo sapiens; identical to SEQ ID NO: 3261

SEQ ID NO: 3335 - DNA, 1056 bp, Homo sapiens; identical to SEQ ID NO: 3288

SEQ ID NO: 3336 - DNA, 1051 bp, Homo sapiens; identical to SEQ ID NO: 3263

SEQ ID NO: 3337 - DNA, 2407 bp, Homo sapiens; identical to SEQ ID NO: 3281

SEQ ID NO: 3338 - DNA, 1056 bp, Homo sapiens; identical to SEQ ID NO: 3288

SEQ ID NO: 3339 - DNA, 554 bp, Homo sapiens; identical to SEQ ID NO: 3295

SEQ ID NO: 3340 - DNA, 747 bp, Homo sapiens; identical to SEQ ID NO: 3298

SEQ ID NO: 3341 - DNA, 902 bp, Homo sapiens; identical to SEQ ID NO: 3302

SEQ ID NO: 3342 - DNA, 544 bp, Homo sapiens; identical to SEQ ID NO: 3282

SEQ ID NO: 3343 - DNA, 654 bp, Homo sapiens; identical to SEQ ID NO: 3275

SEQ ID NO: 3344 - DNA, 2407 bp, Homo sapiens; identical to SEQ ID NO: 3281

SEQ ID NO: 3345 - DNA, 787 bp, Homo sapiens
atagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 3346 - DNA, 807 bp, Homo sapiens; identical to SEQ ID NO: 3297

SEQ ID NO: 3347 - DNA, 714 bp, Homo sapiens; identical to SEQ ID NO: 3279

SEQ ID NO: 3348 - DNA, 859 bp, Homo sapiens; identical to SEQ ID NO: 3306

SEQ ID NO: 3349 - DNA, 1051 bp, Homo sapiens; identical to SEQ ID NO: 3263

SEQ ID NO: 3350 - DNA, 2407 bp, Homo sapiens; identical to SEQ ID NO: 3268

SEQ ID NO: 3351 - DNA, 993 bp, Homo sapiens; identical to SEQ ID NO: 3278

SEQ ID NO: 3352 - DNA, 880 bp, Homo sapiens; identical to SEQ ID NO: 3267

SEQ ID NO: 3353 - DNA, 3055 bp, Homo sapiens
gtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgggcgccggtctgggtaccaatgcctcgttggcccagatggtgagcggccttgtggggcagcttcttatgcagccagtccttgtggctcaggggaccccagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctct

SEQ ID NO: 3354 - DNA, 554 bp, Homo sapiens; identical to SEQ ID NO: 3295

SEQ ID NO: 3355 - DNA, 1051 bp, Homo sapiens; identical to SEQ ID NO: 3263

SEQ ID NO: 3356 - DNA, 654 bp, Homo sapiens; identical to SEQ ID NO: 3275

SEQ ID NO: 3357 - DNA, 783 bp, Homo sapiens; identical to SEQ ID NO: 3296

SEQ ID NO: 3358 - DNA, 902 bp, Homo sapiens; identical to SEQ ID NO: 3302

SEQ ID NO: 3359 - DNA, 1056 bp, Homo sapiens; identical to SEQ ID NO: 3288

SEQ ID NO: 3360 - DNA, 544 bp, Homo sapiens; identical to SEQ ID NO: 3282

SEQ ID NO: 3361 - DNA, 766 bp, Homo sapiens; identical to SEQ ID NO: 3273

SEQ ID NO: 3362 - DNA, 3648 bp, Homo sapiens
ggggaagtcgggggcggagccgcggggtggtgggtgggtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 3363 - DNA, 993 bp, Homo sapiens; identical to SEQ ID NO: 3278

SEQ ID NO: 3364 - DNA, 1688 bp, Homo sapiens
gtgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtctgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 3365 - DNA, 3652 bp, Homo sapiens
ggggaagtcgggggcggagccgcggggtggtgggtgggtgggtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 3366 - DNA, 513 bp, Homo sapiens; identical to SEQ ID NO: 3294

SEQ ID NO: 3367 - DNA, 3751 bp, Homo sapiens; identical to SEQ ID NO: 3304

SEQ ID NO: 3368 - DNA, 844 bp, Homo sapiens; identical to SEQ ID NO: 3291

SEQ ID NO: 3369 - DNA, 554 bp, Homo sapiens; identical to SEQ ID NO: 3295

SEQ ID NO: 3370 - DNA, 736 bp, Homo sapiens; identical to SEQ ID NO: 3333

SEQ ID NO: 3371 - DNA, 844 bp, Homo sapiens; identical to SEQ ID NO: 3291

SEQ ID NO: 3372 - DNA, 902 bp, Homo sapiens; identical to SEQ ID NO: 3302

SEQ ID NO: 3373 - DNA, 844 bp, Homo sapiens; identical to SEQ ID NO: 3291

SEQ ID NO: 3374 - DNA, 1710 bp, Homo sapiens; identical to SEQ ID NO: 3332

SEQ ID NO: 3375 - DNA, 544 bp, Homo sapiens; identical to SEQ ID NO: 3282

SEQ ID NO: 3376 - DNA, 844 bp, Homo sapiens; identical to SEQ ID NO: 3291

SEQ ID NO: 3377 - DNA, 993 bp, Homo sapiens; identical to SEQ ID NO: 3278

SEQ ID NO: 3378 - DNA, 3755 bp, Homo sapiens; identical to SEQ ID NO: 3254

SEQ ID NO: 3379 - DNA, 1689 bp, Homo sapiens
ggtgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtctgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 3380 - DNA, 993 bp, Homo sapiens; identical to SEQ ID NO: 3278

SEQ ID NO: 3381 - DNA, 2407 bp, Homo sapiens; identical to SEQ ID NO: 3268

SEQ ID NO: 3382 - DNA, 766 bp, Homo sapiens; identical to SEQ ID NO: 3273

SEQ ID NO: 3383 - DNA, 993 bp, Homo sapiens; identical to SEQ ID NO: 3278

SEQ ID NO: 3384 - DNA, 3755 bp, Homo sapiens; identical to SEQ ID NO: 3254

SEQ ID NO: 3385 - DNA, 736 bp, Homo sapiens; identical to SEQ ID NO: 3333

SEQ ID NO: 3386 - DNA, 1056 bp, Homo sapiens; identical to SEQ ID NO: 3288

SEQ ID NO: 3387 - DNA, 880 bp, Homo sapiens; identical to SEQ ID NO: 3267

SEQ ID NO: 3388 - DNA, 880 bp, Homo sapiens; identical to SEQ ID NO: 3267

SEQ ID NO: 3389 - DNA, 736 bp, Homo sapiens; identical to SEQ ID NO: 3261

SEQ ID NO: 3390 - DNA, 747 bp, Homo sapiens; identical to SEQ ID NO: 3266

SEQ ID NO: 3391 - DNA, 859 bp, Homo sapiens; identical to SEQ ID NO: 3306

SEQ ID NO: 3392 - DNA, 554 bp, Homo sapiens; identical to SEQ ID NO: 3295

SEQ ID NO: 3393 - DNA, 902 bp, Homo sapiens
tccctaagccgtcgatctcctgccctttgtgtttctctccctgtgccccggaatcagaagggggatggggacaggtgtgaatgtgtgtgtgtgcaggagatactttttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaa

SEQ ID NO: 3394 - DNA, 544 bp, Homo sapiens; identical to SEQ ID NO: 3282

SEQ ID NO: 3395 - DNA, 654 bp, Homo sapiens; identical to SEQ ID NO: 3275

SEQ ID NO: 3396 - DNA, 3751 bp, Homo sapiens; identical to SEQ ID NO: 3304

SEQ ID NO: 3397 - DNA, 714 bp, Homo sapiens; identical to SEQ ID NO: 3279

SEQ ID NO: 3398 - DNA, 654 bp, Homo sapiens; identical to SEQ ID NO: 3275

SEQ ID NO: 3399 - DNA, 554 bp, Homo sapiens; identical to SEQ ID NO: 3295

SEQ ID NO: 3400 - DNA, 747 bp, Homo sapiens; identical to SEQ ID NO: 3298

SEQ ID NO: 3401 - DNA, 1051 bp, Homo sapiens; identical to SEQ ID NO: 3263

SEQ ID NO: 3402 - DNA, 807 bp, Homo sapiens; identical to SEQ ID NO: 3274

SEQ ID NO: 3403 - DNA, 859 bp, Homo sapiens; identical to SEQ ID NO: 3306

SEQ ID NO: 3404 - DNA, 783 bp, Homo sapiens; identical to SEQ ID NO: 3296

SEQ ID NO: 3405 - DNA, 736 bp, Homo sapiens; identical to SEQ ID NO: 3261

SEQ ID NO: 3406 - DNA, 680 bp, Homo sapiens; identical to SEQ ID NO: 3283

SEQ ID NO: 3407 - DNA, 783 bp, Homo sapiens; identical to SEQ ID NO: 3296

SEQ ID NO: 3408 - DNA, 1056 bp, Homo sapiens; identical to SEQ ID NO: 3288

SEQ ID NO: 3409 - DNA, 517 bp, Homo sapiens
gtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 3410 - DNA, 3881 bp, Homo sapiens
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctct

SEQ ID NO: 3411 - DNA, 3059 bp, Homo sapiens
gtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgggcgccggtctgggtaccaatgcctcgttggcccagatggtgagcggccttgtggggcagcttcttatgcagccagtccttgtggctcaggggaccccagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctct

SEQ ID NO: 3412 - DNA, 3055 bp, Homo sapiens; identical to SEQ ID NO: 3353

SEQ ID NO: 3413 - DNA, 3569 bp, Homo sapiens
gtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggc

SEQ ID NO: 3414 - DNA, 3565 bp, Homo sapiens
gtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggc

SEQ ID NO: 3415 - DNA, 3881 bp, Homo sapiens; identical to SEQ ID NO: 3410

SEQ ID NO: 3416 - DNA, 3569 bp, Homo sapiens; identical to SEQ ID NO: 3413

SEQ ID NO: 3417 - DNA, 3055 bp, Homo sapiens; identical to SEQ ID NO: 3353

SEQ ID NO: 3418 - DNA, 3885 bp, Homo sapiens
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctct

SEQ ID NO: 3419 - DNA, 3565 bp, Homo sapiens; identical to SEQ ID NO: 3414

SEQ ID NO: 3420 - DNA, 3059 bp, Homo sapiens; identical to SEQ ID NO: 3411

SEQ ID NO: 3421 - DNA, 3055 bp, Homo sapiens; identical to SEQ ID NO: 3353

SEQ ID NO: 3422 - DNA, 3885 bp, Homo sapiens; identical to SEQ ID NO: 3418

SEQ ID NO: 3423 - DNA, 3881 bp, Homo sapiens; identical to SEQ ID NO: 3410

SEQ ID NO: 3424 - DNA, 3885 bp, Homo sapiens; identical to SEQ ID NO: 3418

SEQ ID NO: 3425 - DNA, 3565 bp, Homo sapiens; identical to SEQ ID NO: 3414

SEQ ID NO: 3426 - DNA, 3569 bp, Homo sapiens; identical to SEQ ID NO: 3413

SEQ ID NO: 3427 - DNA, 3059 bp, Homo sapiens; identical to SEQ ID NO: 3411

SEQ ID NO: 3428 - DNA, 1244 bp, Homo sapiens
atgtgtcctattatccaggctacatcaggaggttggacttcaatgcagtgcatttctagaaacagtttgttaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgag

SEQ ID NO: 3429 - DNA, 7110 bp, Homo sapiens
gccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgtttttgtttttgtttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccttaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgtaatctgtatataggaaaatttttcctatggatatttttggtgttttaccacagtgaactgatttgtagcacttatgaagtgcagaaggtaatattcttgaaaatagaaaaaggttgggtgagcaggctttaatgcctttcccccaagaatatacatcgaatttttcttaatcttttggggttggccagcttccagatttcattaataatgagctctgcctttaataaaagtacatgatcatagctacactgtatgtttaggtggtgtgaaatgatttataatcacagcttgaactgtgtttgcttggtactgtcatagtgattacaaatttcatggaatgcgaagagcaacaataaataaaaaataccactcaccctc

SEQ ID NO: 3430 - DNA, 2610 bp, Homo sapiens
atgggtcgctccaattctagatcacattcttcaaggtcaaagtctagatcacagtctagttctcgatcaagatcaagatctcattctagaaagaagcgatacaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataa

SEQ ID NO: 3431 - DNA, 4373 bp, Homo sapiens
ttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgt

SEQ ID NO: 3432 - DNA, 4186 bp, Homo sapiens
gagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaa

SEQ ID NO: 3433 - DNA, 7263 bp, Homo sapiens
gccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgtttttgtttttgtttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccttaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgtaatctgtatataggaaaatttttcctatggatatttttggtgttttaccacagtgaactgatttgtagcacttatgaagtgcagaaggtaatattcttgaaaatagaaaaaggttgggtgagcaggctttaatgcctttcccccaagaatatacatcgaatttttcttaatcttttggggttggccagcttccagatttcattaataatgagctctgcctttaataaaagtacatgatcatagctacactgtatgtttaggtggtgtgaaatgatttataatcacagcttgaactgtgtttgcttggtactgtcatagtgattacaaatttcatggaatgcgaagagcaacaataaataaaaaataccactcaccctc

SEQ ID NO: 3434 - DNA, 1029 bp, Homo sapiens
atgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctaggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagt

SEQ ID NO: 3435 - DNA, 1854 bp, Homo sapiens
aagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagt

SEQ ID NO: 3436 - DNA, 1851 bp, Homo sapiens
aagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagt

SEQ ID NO: 3437 - DNA, 6390 bp, Homo sapiens
ggtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattg

SEQ ID NO: 3438 - DNA, 6358 bp, Homo sapiens
gctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattg

SEQ ID NO: 3439 - DNA, 6338 bp, Homo sapiens
ggtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattgaa

SEQ ID NO: 3440 - DNA, 2230 bp, Homo sapiens
atgtatgtgctgtgccttataggaccatgatgcaaggagaaagtggtagacggtgtaggactcagccatgttcacatctgcctagatctcatgaccaaaggcacatggcattccactcacagaagggctgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggaagtcccctcaaatagctagggggagtgttgaagggaaaaaaacagacgacaagaccagtaaaacagacctgtagaaatgatttaagcagaagaggactggtgaagctgaactaccatcaaagctacgagagatcctacacacccagatttaaaaaataataaaaacttaagggca

SEQ ID NO: 3441 - DNA, 6258 bp, Homo sapiens
gctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattgaa

SEQ ID NO: 3442 - DNA, 288 bp, Homo sapiens
tccattcatgcactgaagcgcgtgcagagctgctgatcgctgccattgttactcgcgggcggtgtgggagctgagcctccactctggcgagagataaatggcctctgacagcccctcctcgccaagagagctcctcggatttcaccgcgcggcggctctcagactagacgcttgaagcaaagctgccatcccagaagacgacatgctctcagcaacccccctgtatgggaacgttcacagctggatgaacagcgagagggtccgcatgtgtggggcgagcgaagacag

SEQ ID NO: 3443 - DNA, 2618 bp, Homo sapiens
aagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggatt

SEQ ID NO: 3444 - DNA, 6860 bp, Homo sapiens
acacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggagggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaa

SEQ ID NO: 3445 - DNA, 6934 bp, Homo sapiens
tgagccctcccttcttcctctcagttcctagagtccgaccgccgccgccgccgagagagaggagaaggagggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaagggcaaaggtcgttggagccagcagaagacacgatctcccaaatctcccaccccagtgaaacccacagaaccatgtacaccctctaagtcccgaagtgccagctcagaggaggcctcagagtcacctacagcccggcagatccccccagaggcacgtcggctcatagtgaacaaaaatgctggtgagaccctcctgcagagggcggcgcgtcttggctataaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgct

SEQ ID NO: 3446 - DNA, 6322 bp, Homo sapiens
tgagccctcccttcttcctctcagttcctagagtccgaccgccgccgccgccgagagagaggagaaggagggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctgatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgct

SEQ ID NO: 3447 - DNA, 2221 bp, Homo sapiens
gcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctgatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaag

SEQ ID NO: 3448 - DNA, 5648 bp, Homo sapiens
acgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaagggcaaaggtcgttggagccagcagaagacacgatctcccaaatctcccaccccagtgaaacccacagaaccatgtacaccctctaagtcccgaagtgccagctcagaggaggcctcagagtcacctacagcccggcagatccccccagaggcacgtcggctcatagtgaacaaaaatgctggtgagaccctcctgcagagggcggcgcgtcttggctataaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatgg

SEQ ID NO: 3449 - DNA, 7127 bp, Homo sapiens
ggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcttcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaagccagtttgaggatgggacaatctgttctctagaggctcctgagccatgcgggagcattggtggttattttctttgtattgtgtttgttctttgttcctgggggggaagttctcggcccccttctgtaggactgctccccacccccaccatactgcccagttggttttgaacagttgttttccctttttaagaaaaaaaaatacatatatatatacatatatatatataaagttgaggggttttggactttaatttgttggttttgttggggttcctggtattgtgtagtttatttcatgttctgtttgcctttccttttttcgcatttgggtgtatattctggctgccctttatgtttcattttaagcaactggctgtggagtcaaaaacacttgcatactgaaaaacctgtgtcaggg

SEQ ID NO: 3450 - DNA, 1454 bp, Homo sapiens
gaaaggacccggggcggggccgaacgcagcttccccaaggtgcaggcgcggtgaaaccatcgagacggagggccagagagtcacggcggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 3451 - DNA, 1583 bp, Homo sapiens
aaaccatcgagacggagggccagagagtcacggcggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 3452 - DNA, 1525 bp, Homo sapiens
atcgagacggagggccagagagtcacggcggatcttattgtctacgatgtgacgatccgtggagaaagtagcagatgggcagattttcatttggggagaatgagggagaaaagaacgggcattccgagccaagagcactgcatgagcaaggagttgggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacact

SEQ ID NO: 3453 - DNA, 1584 bp, Homo sapiens
gtcacggcggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 3454 - DNA, 1430 bp, Homo sapiens
cacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 3455 - DNA, 583 bp, Homo sapiens
gagacggagggccagagagtcacggcggggtctgctgggagccagccattgaaggtgctggagcagagagagatatggtattggagctgatccctatgatgaaagatctggacccttgtgtagatgttccgtgaagcaggaggtgaagacctattaaaatgccatttcaagaactacgattttaaagacagtttaggtgggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcggggga

SEQ ID NO: 3456 - DNA, 804 bp, Homo sapiens
aaggaggacgctgagccgtcaagattaagaaccttcacctgcgggagggcagggtgaggtaggagacaggtgggcaccagagaagaaatacgcttatcttccgggcaggagggctgaggaagagaaaggacagactaaggcagagagaaggcctggagaaacaacgggccccggcctagcgacccaggttcccacctgcctctggctctgactcaccgcgtggtcttggacagacacagtcgcttcgcttctctgggcctcagctttcctatctgtaaaatggaggtgatgacagtgtccacatcgtcgggcaggagctggatcataagagccagcgaactggaaaggcggtttgtaacctggaaggcttgggatggagcatcgtcatgattttgtcctgagagcagcaggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacct

SEQ ID NO: 3457 - DNA, 1036 bp, Homo sapiens
cgggagggcagggtgaggtaggagacaggtgggcaccagagaagaaatacgcttatcttccgggcaggagggctgaggaagagaaaggacagactaaggcagagagaaggcctggagaaacaacgggccccggcctagcgacccaggttcccacctgcctctggctctgactcaccgcgtggtcttggacagacacagtcgcttcgcttctctgggcctcagctttcctatctgtaaaatggaggtgatgacagtgtccacatcgtcgggcaggagctggatcataagagccagcgaactggaaaggcggtttgtaacctggaaggcttgggatggagcatcgtcatgattttgtcctgagagcagcaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccag

SEQ ID NO: 3458 - DNA, 2015 bp, Homo sapiens
aaaccatgtggctggaggcgcgagctggggtgtgggcgaggttcaggagggggttcctgggtgtcgcggaggggccggggacgggagagctttgtctgtggccttccatgcataggtgttttggaattctggatcccagttctgaggctcagccgaggtcactgctgtcagctcacctccctgcatgccaggcgcagggcaaagtggccggggttcggggttggaggagaggtgtactagaaacaactttgctcttgtccctcaggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggtaggtgggcgccgtattgtagagagccttgagtaccaggctgagtttatacccaattcaggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacact

SEQ ID NO: 3459 - DNA, 1483 bp, Homo sapiens
acgggttaccccaaaccatgtggctggaggcgcgagctggggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctc

SEQ ID NO: 3460 - DNA, 815 bp, Homo sapiens
cccagagccggcgggagccgcatctctatggtcggccgcggctggaacggcccccggggcccgctttgtgcgaccgcctccggctcagccgcctctaggatattggggatgtggaagccactctctcttcctcttgccggctgccggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccag

SEQ ID NO: 3461 - DNA, 2063 bp, Homo sapiens
aattttccatgctggaagtggaaggaattgcttgctcatttatattctctatcctgtggaaagccttccctcccaccccttgagccagtgagtcacttcctctctgcaaacctctaaagcctcctttctttctcagcccagacctggccctctggagagggttttggagtcctgggtaggcagggtacctcaggcagcaggcagcacaccttggatgtgagctgaatggattttcaaatttcacagaaggagcctccatgctggagaaagtatgtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgca

SEQ ID NO: 3462 - DNA, 2207 bp, Homo sapiens
gccggctcggcgccgcccgcgcgcccgcgccagagcagccatgtaccggcgcagctacgtcttccagacccgcaaggagcagtacgagcacgccgacgaggcttcgcgcgccgccgagcccgagcgcccggccgacgagggctgggctggggcaacgagcctggcggcgctgcaggggctcggcgagcgcgtggccgcccacgtccagcgggcccgcgccctcgagcagcgccatgccgggctccggaggcagctggatgccttccagcgcctgggcgagctggccgggcccgaggacgccctcgcccgccaagtcgagagcaaccgccagcgcgtccgggacctggaggccgagcgcgcccggctggagcgccagggcaccgaggcgcagcgcgcgctcgacgagttccgaagcaagtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgca

SEQ ID NO: 3463 - DNA, 2183 bp, Homo sapiens
gaggcgaccgtggccatgcagagtgctctgtgagtcaccgttaatttcagatggggtaaggtgaagagacgttccttgggagcccagaggagtacaggatctgatcccaagccctttaccaacaggccgcatgacacagcacttgtgagtgaggctgaacaagagaaatgagatttgaggatgtttcctgaggtcctactgtgtgccagctgcggccatgttagctaccaggaatatgaagatgaataaggagatcacaagtgaaaacagaaatgccaagataaacttggcccaagttcccttgggaattctcaggatcctacctggtgcagcagatcacaccagggagatgttactggatctttgatgagtggagcatccacagaggaaggaagtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgc

SEQ ID NO: 3464 - DNA, 2075 bp, Homo sapiens
cctttctttctcagcccagacctggccctctggagagggttttggagtcctgggtaggcagggtacctcaggcagcaggcagcacaccttggatgtgagctgaatggattttcaaatttcacagaaggagcctccatgctggagaaagtatagacagggtctcactatgttgcccagaatggggtgcagtggctattcacaggaatgatcattgctcactgcagccttgaactcccggtctccagtgatcctcccgcctcagcctctcaagtagctgggattacaggtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgc

SEQ ID NO: 3465 - DNA, 1558 bp, Homo sapiens
cgtgaccaggccacagggatgctggggctgtaaaccaaaagccactggactctgtaaacccactgggcaccacagaggcagaaggggtgatgagtgagaggcgagtggtagtggacttgcccaccagtgccagctccagcatgcccctccagaggcgcagggcgtccttcagggggccacggtcatcatcctccctggagagccccccagcctccaggaccaatgccatgagtggccttgtccgagcacccggggtctatgtaggaacagcacccagtgggtgcataggtggcttgggtgcccgtgtgacccgccgggccctcggcatcagcagtgtcttccttcagggcctgcggagctcaggcctggccaccgtgccggctccaggtttggagagggaccatggtgctgttgaggacctagggggctgcctggtggaatatatggccaaagtgcacgcccttgagcaagtcagtcaggagctggaaacacaactgcggatgcacctggagagcaaagccacacgctcgggaaactggggtgccctacgggcttcctgggccagcagctgccagcaggtgggtgaggcagtcttggaaaatgcccggctcatgctgcagacagaaactatccaggccggagcagatgactttaaagagagatatgaaaatgagcagccatttcgaaaggcggcagaagaggaaattaactctctgtataaagtcattgatgaggctaatttgactaaaatggacctggagagtcaaatagaaagtctgaaagaagaacttggctctctatcaagaaactatgaagaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaagcaacaggcggaggtggcccacatgtcccagacccaggaggagaagctggcagctgccctcagggtggagttacacaacacttcgtgccaagtccagagcctccaggctgagacagaatccttacgtgccctgaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgctt

SEQ ID NO: 3466 - DNA, 2143 bp, Homo sapiens
ggaagttttccggcggctaccgggaagtcgctgaagacagagcgatggtagttctggaggcctcgctccggggccgacccgaggccacagtgcctccgcggtagaccggacttgggtgacgggctccgggctcccgaggtgaagagcatcgggggctgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaaactgcc

SEQ ID NO: 3467 - DNA, 1565 bp, Homo sapiens
ccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccagacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacct

SEQ ID NO: 3468 - DNA, 2500 bp, Homo sapiens
ccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggtgcctactacttctcagcccccattccttgccaaaggctagtagaattttaattaaatccaggaatcgagacctggagccaggtgatagagatgcatcatcacctagccttttggccctttcagaaaagatgtattcccttatacctggcccgtcaccttccagtatggattttttcctgtagctgttcacagagtgggaaaggatagtagctttaatgatgaagtattgaaaaaaattgagggagtgattgaccaatcaccaagagatgggctcttgagaagtttcaaactagcaaatgttgttagatgttcaggtccttagttctcattgctgcaggtaaagagcttgctggcaaggggtataatattttctaaaatggcctttcctggttctcccttcttttccactgtagacatatgaattttttatgctccctctccctccttagtccaccaaggccaaccttcatgctgagtgtccctgtggaagaccagcatggccttcctttgggagagaggtacccttgggaggtcagtcgggctaggagtgggtatgttccttgaggcccctcagctggtgcttgagagtctctgccactggcattgtagtaggtggaggaagcctctctgttccctcatgtggcccgtgggcggggggctgtctgcaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaactt

SEQ ID NO: 3469 - DNA, 7508 bp, Homo sapiens
ctgaggctcagccctcctcggagcccaccatctcgaggctcctggactgtaagggacccctgcagtccccagagcagaggccagcaggggctgagactatgaggcaagcagcccatcgacccaggcctccttaggaccagcccagccacccagcaagcgaaagagcagcagcagagagcagagccggagataaaggaccacagcggaccactggggatcacccccagcagctcctgaagcctctggccgggctgaggggttgcgacagacggccagacccacagacactgacagacacacaacgacaccgatgcacacagctgcacgacactgacacactcagatacaaccagggacagcatcacatactgccacagccctgcaatacagacacccacacacacacacacaaacaactggcaactctgaaatgggcagacagtgacacacagcaccacccccctcaacacacagaagtgggggcacccatcttcccaacacatgagacagcattgacctgcacggacagacctggagacacacacacgcaccctcacccaggcgcagctgtcggtggcctctgcacatcctccctacccccacagggacaccctcgctcctccacatactcgcgcacacacacagctaccagcaaacatagctcacatacccctggctccagctccagcagccctggcgccttctgcagcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagaggaagaacgccgagctggcggtcattgccaagcgcctggaggagagggcccgaaagctgcaggaaacgaacctgagggtggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacaggaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagagtgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcaggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatggggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttc

SEQ ID NO: 3470 - DNA, 7688 bp, Homo sapiens
ctgaggctcagccctcctcggagcccaccatctcgaggctcctggactgtaagggacccctgcagtccccagagcagaggccagcaggggctgagactatgaggcaagcagcccatcgacccaggcctccttaggaccagcccagccacccagcaagcgaaagagcagcagcagagagcagagccggagataaaggaccacagcggaccactggggatcacccccagcagctcctgaagcctctggccgggctgaggggttgcgacagacggccagacccacagacactgacagacacacaacgacaccgatgcacacagctgcacgacactgacacactcagatacaaccagggacagcatcacatactgccacagccctgcaatacagacacccacacacacacacacaaacaactggcaactctgaaatgggcagacagtgacacacagcaccacccccctcaacacacagaagtgggggcacccatcttcccaacacatgagacagcattgacctgcacggacagacctggagacacacacacgcaccctcacccaggcgcagctgtcggtggcctctgcacatcctccctacccccacagggacaccctcgctcctccacatactcgcgcacacacacagctaccagcaaacatagctcacatacccctggctccagctccagcagccctggcgccttctgcagcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagaggaagaacgccgagctggcggtcattgccaagcgcctggaggagagggcccgaaagctgcaggaaacgaacctgagggtggtgagtgcccccttgccccggccggggaccagcttggagttgtgtcggaaggccctagcccgccagcgagcccgggacctcagtgagacagccagtgcactgctggccaaggacaagcagattgctgccttgcagcgggagtgcagggagctgcaggccaggctcactctggtgggcaaggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacaggaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagagtgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcaggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatggggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttc

SEQ ID NO: 3471 - DNA, 7626 bp, Homo sapiens
ctgaggctcagccctcctcggagcccaccatctcgaggctcctggactgtaagggacccctgcagtccccagagcagaggccagcaggggctgagactatgaggcaagcagcccatcgacccaggcctccttaggaccagcccagccacccagcaagcgaaagagcagcagcagagagcagagccggagataaaggaccacagcggaccactggggatcacccccagcagctcctgaagcctctggccgggctgaggggttgcgacagacggccagacccacagacactgacagacacacaacgacaccgatgcacacagctgcacgacactgacacactcagatacaaccagggacagcatcacatactgccacagccctgcaatacagacacccacacacacacacacaaacaactggcaactctgaaatgggcagacagtgacacacagcaccacccccctcaacacacagaagtgggggcacccatcttcccaacacatgagacagcattgacctgcacggacagacctggagacacacacacgcaccctcacccaggcgcagctgtcggtggcctctgcacatcctccctacccccacagggacaccctcgctcctccacatactcgcgcacacacacagctaccagcaaacatagctcacatacccctggctccagctccagcagccctggcgccttctgcagcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagaggaagaacgccgagctggcggtcattgccaagcgcctggaggagagggcccgaaagctgcaggaaacgaacctgagggtggtgagtgcccccttgccccggccggggaccagcttggagttgtgtcggaaggccctagcccgccagcgagcccgggacctcagtgagacagccagtgcactgctggccaaggacaagcagattgctgccttgcagcgggagtgcagggagctgcaggccaggctcactctggtgggcaaggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacaggaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagagtgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcaggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatggggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcaggactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttc

SEQ ID NO: 3472 - DNA, 1364 bp, Homo sapiens
acttccccgggagccggaagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagctt

SEQ ID NO: 3473 - DNA, 1683 bp, Homo sapiens
agtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagctt

SEQ ID NO: 3474 - DNA, 1693 bp, Homo sapiens
cggcgggctggtttccatggttgcacgattaggtaggggctccgggcgctttgcccacccccgagctggaggggactggcgggaagcggcggttggctgcagggcgctccgccgggcgtggggtgtagccgtgtcggtgagcgagctctgctcgaggcggagaggagaaactcgggaagcaattgtggctactctaaggctactggtttcgagtcaggccgtgcgaccttaggcaagtcgcacattctctccgtgcagctgcctagcagtgtggattcagtatcaccgtgtgtgtaaagctctttctaagaatcgtaaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaata

SEQ ID NO: 3475 - DNA, 1516 bp, Homo sapiens
tacaaaagcggccggcggagaggggcgggacttccccgggagccggaagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaata

SEQ ID NO: 3476 - DNA, 1440 bp, Homo sapiens
tacaaaagcggccggcggagaggggcgggacttccccgggagccggaagtcccgtctcacggttgccctggcagcgcgcgaggctggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctc

SEQ ID NO: 3477 - DNA, 2038 bp, Homo sapiens
atcttaggtataaaatcggctccagtcgcggtaactgaagccaagctccgcccctaccctcctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctgggtatggcagatctattgcttgatgatcctctccccccaagaattctaacacaggagctgtcctgaggctctggatgactttattcttcaaatggctttaccctcccagtagctccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 3478 - DNA, 992 bp, Homo sapiens
atggttgcacgattaggtaggggctccgggcgctttgcccacccccgagctggaggggactggcgggaagcggcggttggctgcagggcgctccgccgggcgtggggtgtagccgtgtcggtgagcgagctctgctcgaggcggagaggagaaactcgggaagcaattgtggctactctaaggctactggtttcgagtcaggccgtgcgaccttaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcag

SEQ ID NO: 3479 - DNA, 794 bp, Homo sapiens
agtgattcttcgttatggccgcccgtgtgccttcgactcaatcgggaggacaccgaaatccagatttcggggttgcagggcgcgggccccggcttggttagggcaggggcagccattttgagaccagaagagggcggaagggaccatattgagaacgccggttgcctgggggccgccattttaagagaagccctgtacggtaaactccgtgacgtgggggctgccatgttggtacggccatcttggaatgggagtggctgtgggcgcagccatcttagatctattgcttgatgatcctctccccccaagaattctaacacaggagctgtcctgaggctctggatgactttattcttcaaatggctttaccctcccagtagctccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctg

SEQ ID NO: 3480 - DNA, 865 bp, Homo sapiens
ctctgatctccgatccttgacgatgtctagcctgcattgattggcccttttccctggggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactgg

SEQ ID NO: 3481 - DNA, 553 bp, Homo sapiens
agagtctgacggggccctgctgtgggtggagcaaagggtgcctcatatctctggggtgcttggggtcggccacaaaggtggtaggaaatggggtcgacagataggtgagggtgggccttgtgcttcagataacctcacatggtcaggcaagggttagggatgggatgcaaggagcctaaggggctcacaacaattactgacctaaggaagggcccaggagagggaaaagggaggagttgtgagaagggacaggggagctcagaggagagcacagaagaacttcttctcccggaaggggttctccgaagtgggcacaggggtgatgaggggatcctcacaggcgtgggcatcacaggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaag

SEQ ID NO: 3482 - DNA, 539 bp, Homo sapiens
agtgattcttcgttatggccgcccgtgtgccttcgactcaatcgggaggacaccgaaatccagatttcggggttgcagggcgcgggccccggcttggttagggcaggggcagccattttgagaccagaagagggcggaagggaccatattgagaacgccggttgcctgggggccgccattttaagagaagccctctctgaagacctcaaccaaccctgatgaggagggcacatcacccctgtctgctccagtgagccccaacaggagaaaaacaggccattacttacctgaagccacaagcggcagtagcagccctgggtgtaggggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagagg

SEQ ID NO: 3483 - DNA, 662 bp, Homo sapiens
attttgagaccagaagagggcggaagggaccatattgagaacgccggttgcctgggggccgccattttaagagaagccctgtacggtaaactccgtgacgtgggggctgccatgttggtacggccatcttggaatgggagtggctgtgggcgcagccatcttagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgaca

SEQ ID NO: 3484 - DNA, 585 bp, Homo sapiens
acctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgc

SEQ ID NO: 3485 - DNA, 1829 bp, Homo sapiens
tcaggggtcagaacactggtggagcagatcctttagcctctggattttagggccatggtagagggggtgttgccctaaattccagccctggtctcagcccaacaccctccaagaagaaattagaggggccatggccaggctgtgctagccgttgcttctgagcagattacaagaagggactaagacaaggactcctttgtggaggtcctggcttagggagtcaagtgacggcggctcagcactcacgtgggcagtgccagcctctaagagtgggcaggggcactggccacagagtcccagggagtcccaccagcctagtcgccagaccttctgtgggatcatcggacccacctggaaccccacctgctggccctcacggaagaacaacagctgatgtttgagaaactgactctgtattgcgacagctacatccagctcatccccatttccttcgtgctggggaaaggtgcggactgcagccagtgaaactgaagttagacgttaggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacaggtctgtcctccacctgaaccaggggcactgcattgccctgtgccccaccccagcttcccttgctctgagcctacccttcctccacaatttcctagggttccatcactgccagagcacactggacctacgcccagcactggcttggggtatatacttggccaccttcacagggatcctagggaagtgttcgggaccttttctcacttcaccctggtatcacccggaagacttcttgggaccaggtgaaggaagatgaggttgtgctgaccagaatgctgctggagaactgccccagggctgacaggccaggcttagctgagcagatgttatcactggccccaacttactttgagcaagggtggctgacccaaaaccatgaggtggcagtcagctggatgacagatgaacacttcccccataactatttagggtagtacccaagcactacagg

SEQ ID NO: 3486 - DNA, 2598 bp, Homo sapiens
caaggctgggaccagaaaccaggactgttgactgcagcccggtattcattctttccatagcccacagggctgtcaaagaccccagggcctagtcagaggctcctccttcctggagagttcctggcacagaagttgaagctcagcacagccccctaacccccaactctctctgcaaggcctcaggggtcagaacactggtggagcagatcctttagcctctggattttagggccatggtagagggggtgttgccctaaattccagccctggtctcagcccaacaccctccaagaagaaattagaggggccatggccaggctgtgctagccgttgcttctgagcagattacaagaagggactaagacaaggactcctttgtggaggtcctggcttagggagtcaagtgacggcggctcagcactcacgtgggcagtgccagcctctaagagtgggcaggggcactggccacagagtcccagggagtcccaccagcctagtcgccagaccttctgtgggatcatcggacccacctggaaccccacctgacccaagcccacctgctgcagcccactgcctggccatgaccatcacttacacaagccaagtggctaatgcccgcttaggctccttctcccgcctgctgctgtgctggcggggcagcatctacaagctgctatatggcgagttcttaatcttcctgctctgctactacatcatccgctttatttataggctggccctcacggaagaacaacagctgatgtttgagaaactgactctgtattgcgacagctacatccagctcatccccatttccttcgtgctgggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgagatgaacaccttgcgtactcagtgtggacacctgtatgcctacgactggattagtatcccactggtgtatacacaggtggtgactgtggcggtgtacagcttcttcctgacttgtctagttgggcggcagtttctgaacccagccaaggcctaccctggccatgagctggacctcgttgtgcccgtcttcacgttcctgcagttcttcttctatgttggctggctgaaggtgtccctgttggctgtggatgagatgcaccaggacctgcctcggatggagccggacatgtactggaataagcccgagccacagcccccctacacagctgcttccgcccagttccgtcgagcctcctttatgggctccaccttcaacatcagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcctttaatgccttttattcataaaaactgtgaaagctagactgaaccattggaaacatttaactcagactctggattcagagtcgggaacccttagttctatctgaatccaagacagccacaccttagtatactgcccaaactaatgagtttaataaatacaaatactcgtttc

SEQ ID NO: 3487 - DNA, 2740 bp, Homo sapiens
agataagggcactgaggctgagagaggagctgaaacctacccggggtcaccacacacaggtggcaaggctgggaccagaaaccaggactgttgactgcagcccggtattcattctttccatagcccacagggctgtcaaagaccccagggcctagtcagaggctcctccttcctggagagttcctggcacagaagttgaagctcagcacagccccctaacccccaactctctctgcaaggcctcaggggtcagaacactggtggagcagatcctttagcctctggattttagggccatggtagagggggtgttgccctaaattccagccctggtctcagcccaacaccctccaagaagaaattagaggggccatggccaggctgtgctagccgttgcttctgagcagattacaagaagggactaagacaaggactcctttgtggaggtcctggcttagggagtcaagtgacggcggctcagcactcacgtgggcagtgccagcctctaagagtgggcaggggcactggccacagagtcccagggagtcccaccagcctagtcgccagaccttctgtgggatcatcggacccacctggaaccccacctgacccaagcccacctgctgcagcccactgcctggccatgaccatcacttacacaagccaagtggctaatgcccgcttaggctccttctcccgcctgctgctgtgctggcggggcagcatctacaagctgctatatggcgagttcttaatcttcctgctctgctactacatcatccgctttatttataggctggccctcacggaagaacaacagctgatgtttgagaaactgactctgtattgcgacagctacatccagctcatccccatttccttcgtgctgggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgagatgaacaccttgcgtactcagtgtggacacctgtatgcctacgactggattagtatcccactggtgtatacacaggtggtgactgtggcggtgtacagcttcttcctgacttgtctagttgggcggcagtttctgaacccagccaaggcctaccctggccatgagctggacctcgttgtgcccgtcttcacgttcctgcagttcttcttctatgttggctggctgaaggtggcagagcagctcatcaacccctttggagaggatgatgatgattttgagaccaactggattgtcgacaggaatttgcaggtgtccctgttggctgtggatgagatgcaccaggacctgcctcggatggagccggacatgtactggaataagcccgagccacagcccccctacacagctgcttccgcccagttccgtcgagcctcctttatgggctccaccttcaacatcagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcctttaatgccttttattcataaaaactgtgaaagctagactgaaccattggaaacatttaactcagactctggattcagagtcgggaacccttagttctatctgaatccaagacagccacaccttagtatactgcccaaactaatgagtttaataaatacaaatactcgtt

SEQ ID NO: 3488 - DNA, 1023 bp, Homo sapiens
acagagtcccagggagtcccaccagcctagtcgccagaccttctgtgggatcatcggacccacctggaaccccacctgacccaagcccacctgctgcagcccactgcctggccatgaccatcacttacacaagccaagtggctaatgcccgcttaggctccttctcccgcctgctgctgtgctggcggggcagcatctacaagctgctatatggcgagttcttaatcttcctgctctgctactacatcatccgctttatttataggctggccctcacggaagaacaacagctgatgtttgagaaactgactctgtattgcgacagctacatccagctcatccccatttccttcgtgctgggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgagatgaacaccttgcgtactcagtgtggacacctgtatgcctacgactggattagtatcccactggtgtatacacagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagcc

SEQ ID NO: 3489 - DNA, 4267 bp, Homo sapiens
caccagcctagtcgccagaccttctgtgggatcatcggacccacctggaaccccacctgctggccctcacggaagaacaacagctgatgtttgagaaactgactctgtattgcgacagctacatccagctcatccccatttccttcgtgctgggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgagatgaacaccttgcgtactcagtgtggacacctgtatgcctacgactggattagtatcccactggtgtatacacaggtggtgactgtggcggtgtacagcttcttcctgacttgtctagttgggcggcagtttctgaacccagccaaggcctaccctggccatgagctggacctcgttgtgcccgtcttcacgttcctgcagttcttcttctatgttggctggctgaaggtggcagagcagctcatcaacccctttggagaggatgatgatgattttgagaccaactggattgtcgacaggaatttgcaggtgtccctgttggctgtggatgagatgcaccaggacctgcctcggatggagccggacatgtactggaataagcccgagccacagcccccctacacagctgcttccgcccagttccgtcgagcctcctttatgggctccaccttcaacatcagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacaggtctgtcctccacctgaaccaggggcactgcattgccctgtgccccaccccagcttcccttgctctgagcctacccttcctccacaatttcctagggttccatcactgccagagcacactggacctacgcccagcactggcttggggtatatacttggccaccttcacagggatcctagggaagtgttcgggaccttttctcacttcaccctggtatcacccggaagacttcttgggaccaggtgaaggaagatgaggttgtgctgaccagaatgctgctggagaactgccccagggctgacaggccaggcttagctgagcagatgttatcactggccccaacttactttgagcaagggtggctgacccaaaaccatgaggtggcagtcagctggatgacagatgaacacttcccccataactatttagggtagtacccaagcactacaggaaagggtggcaggaactgcctcactcctaggaactggtagatggtgaggttgagggtgtccagcgcccttaggtcattttctcactgcctgggaacctcaccaaaatacttcttgcttccttggggtcagcccaaagctgtcacaaaatcagatatttccctttattccagatttcctggacactttcacccaattataaacaccccacttcagccccaatcacgtgggaggaagtgtaacttcccttttctggattctcaagcagttactttcacggtcagaacacgcagctattatgattgaaaacttaaaagggcaacaatttcagtcttgcttctagggctagacaggaacttggcaaacatctgtggcctgttcagcaaaggatgttaatatttaagaatcttgtcttgggctgggtgtggaggcaagtggatcacaggaggtcaggagtttgagaccaacctggccaacatgatgaaaccccatctctaccaaaaaaaatacaaatcagctgggcgtcgtggtgtgcctgtagtcccaacgcaggaggttgaggggagaattgcttgaacccaggaggtggtggttgcagtgagattgagcaactgcaatccagcctgggcgacggagtgagactgtctcaaaaaaaaaaaaaaaaggatcgtctcaacctttgccctcctactgcaacattttggtatttgaaatgaagggaccttccatacttatgctgttaatactttcattctcactagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcctttaatgccttttattcataaaaactgtgaaagctagactgaaccattggaaacatttaactcagactctggattcagagtcgggaacccttagttctatctgaatccaagacagccacaccttagtatactgcccaaactaatgagtttaataaatacaaatactcgtttctttttgattagtgtgattagaactgaacaacggcacttaaggaatctggaagatagcctggatagatttctgattcatcccaagacctcaaagacaacacctgggtaccaaatttctttatttgaaggaatggtacaaatcaaagaacttaagtggatgttttggtacaacttatagaaaaggtaaaggaaaccccaacatgcatgcactgccttggtgaccagggaagtcaccccacggctatggggaaattagcccgaggcttagctttcattatcactgtctcccagggtgtgcttgtcaaagagatattccgccaagccagattcgggcgctcccatcttgcgcaagttggtcacgtggtcacccaattctttgatggctttcacctgctcattcaggtaatgtgtctcaatgaagtcacacaactgcaaaacaatggggaagacagttagtgggcagctttcccaatccctaaggcaaatgatttcctccatttatttcctggggttccaatactcacatgggggtcatttttgtcagtggccagtttgtgcagttccagtagtgactgattcacatttttttccaaatgtaatgcacactccattgcattcagcccgctctcccagtcatcacagtctggtttctgaatgagaataggttaatgcatctctaccaactaacctagaagtcagcaagcccatcatctctaaccaccacgttttggcaaaagggacattactatttgcctaatttagtttagatggtaagcctaaaaaagcacaaaaggcaaaagcccagtgtatcatcactttataagggcaattgctagtttaagtgatttctgatacccgaacactgccagatgatgaagtatgacacccctaggatcttttgttcaccttgatatcctgaaggaagattcggccacctcgttggttctgcagcttcatcagtttctcagcatgttccctctcctcatgagattggtgaagaaagtatttggcaaagttcttcaaagccacatcatcgcggtcaaagtagtaaga

SEQ ID NO: 3490 - DNA, 1908 bp, Homo sapiens
atgaccgtcacctacacagcccgagtggcgaacgcccgcttcggtggcttctcccagctgctgctactgtggcgtgggagcatctacaaactcctgtggcgagagctgctctgcttccttgggttctacatggcgctgagtgctgcctaccgctttgtgctgaccgaagggcagaagcgctacttcgagaagcttgtgatttattgtgaccagtatgccagcctcatccctgtctccttcgtgcttggcttttatgtgacgctggtggtgaaccgctggtggagccagtacctatgcatgccgctgcccgacgcgctcatgtgcgtggtggcgggcaccgtgcacggacgcgacgaccgcggccgcctctaccggcgcacactcatgcgctacgcagggctctcggccgtgctcatcctgcgctccgtcagcaccgcggtgttcaagcgcttccccaccatagaccacgtggtggaggctgggtttatgacccgcgaggagcgcaagaagtttgaaaacctgaactcatcctacaacaagtactgggtgccctgcgtctggttctccaacctggcggcacaggcccgacgcgagggccgcatccgcgacaacagcgcccttaagctgctgctcgaggagctgaatgtttttcggggcaaatgtggaatgctctttcactatgactggattagcgtacccctcgtgtacacgcaggtggtgaccatcgcactgtacagctacttcctggcttgcctcattggtcgccagttcctggacccggctcagggttacaaagaccacgacctagacctgtgtgtgcccatcttcaccctcttgcagttcttcttctacgccggctggctcaaggtagctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgctggccaaagaagacatgcagttccagcggctggacggcttggatggaccgatgggagaggcgcccggcgacttcctgcagcgcctcctgccggcgggcgcgggcatggtcgcgggaggcccgctgggccggcgcctgtcctttctactccgcaagaacagctgcgtgtcggaggcgtctactggggccagctgctcatgcgcggttgtccccgaaggcgcggccccggagtgcagctgcggggacccgctgctcgaccccggcctgccggagcccgaggccccgccccctgcgggtcccgaaccgcttaccctcatccctgggcctgtcgagcccttcagcatcgtgaccatgcccgggccccggggtccggcgccaccctggctgcccagccctattggcgaggaggaggagaatctggcctgagatcttagagcccagccccctaaggacagggaaccaggtccctgcacggcacccacgcaggtgtcccggtctgcataagcctcgtgtgcctttgtaaagtccacctacacttttgaccagctctcgctgcccgcatgtgtttggcgctgtgctaggggcgggagttcttccagactcttggaccagcccgccctgaccaccagctctacttcccaacccccactgcctgagaggtctctatcagtgtcctgcctgaattctttccttcaagtgaagatgtgactgactacctcctcgagttgtcatgaggatgaaagaatggcattaaagcatttggtatacagtaggtgctcaataaattgctagtgatttttactc

SEQ ID NO: 3491 - DNA, 2183 bp, Homo sapiens
ctgaagctacagcctagccgagggaggaggaccaggaaagggaggcacgcccactccccagccccacccaacgccaaagccacccgcccattccatccctgtccctgtgggtccttgcaccggccaccttcaacacaggtgagatgagcccaggcttggggaaatagggggccctgagggaagagggaacctgcgggcaggaatgcatccggagtcctcccggggcggggagtggagggcttggaaggctggaggggaacggagagaggaaagcccccacccgggccacccactctcccttggccacacctgccgggtgccacgatgaccgtcacctacacagcccgagtggcgaacgcccgcttcggtggcttctcccagctgctgctactgtggcgtgggagcatctacaaactcctgtggcgagagctgctctgcttccttgggttctacatggcgctgagtgctgcctaccgctttgtgctgaccgaagggcagaagcgctacttcgagaagcttgtgatttattgtgaccagtatgccagcctcatccctgtctccttcgtgcttggcttttatgtgacgctggtggtgaaccgctggtggagccagtacctatgcatgccgctgcccgacgcgctcatgtgcgtggtggcgggcaccgtgcacggacgcgacgaccgcggccgcctctaccggcgcacactcatgcgctacgcagggctctcggccgtgctcatcctgcgctccgtcagcaccgcggtgttcaagcgcttccccaccatagaccacgtggtggaggctgggtttatgacccgcgaggagcgcaagaagtttgaaaacctgaactcatcctacaacaagtactgggtgccctgcgtctggttctccaacctggcggcacaggcccgacgcgagggccgcatccgcgacaacagcgcccttaagctgctgctcgaggagctgaatgtttttcggggcaaatgtggaatgctctttcactatgactggattagcgtacccctcgtgtacacgcaggtggtgaccatcgcactgtacagctacttcctggcttgcctcattggtcgccagttcctggacccggctcagggttacaaagaccacgacctagacctgtgtgtgcccatcttcaccctcttgcagttcttcttctacgccggctggctcaaggtagctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgctggccaaagaagacatgcagttccagcggctggacggcttggatggaccgatgggagaggcgcccggcgacttcctgcagcgcctcctgccggcgggcgcgggcatggtcgcgggaggcccgctgggccggcgcctgtcctttctactccgcaagaacagctgcgtgtcggaggcgtctactggggccagctgctcatgcgcggttgtccccgaaggcgcggccccggagtgcagctgcggggacccgctgctcgaccccggcctgccggagcccgaggccccgccccctgcgggtcccgaaccgcttaccctcatccctgggcctgtcgagcccttcagcatcgtgaccatgcccgggccccggggtccggcgccaccctggctgcccagccctattggcgaggaggaggagaatctggcctgagatcttagagcccagccccctaaggacagggaaccaggtccctgcacggcacccacgcaggtgtcccggtctgcataagcctcgtgtgcctttgtaaagtccacctacacttttgaccagctctcgctgcccgcatgtgtttggcgctgtgctaggggcgggagttcttccagactcttggaccagcccgccctgaccaccagctctacttcccaacccccactgcctgagaggtctctatcagtgtcctgcctgaattctttccttcaagtgaagatgtgactgactacctcctcgagttgtcatgaggatgaaagaatggcattaaa

SEQ ID NO: 3492 - DNA, 2000 bp, Homo sapiens
gtccctgtgggtccttgcaccggccaccttcaacacagcccccacccgggccacccactctcccttggccacacctgccgggtgccacgatgaccgtcacctacacagcccgagtggcgaacgcccgcttcggtggcttctcccagctgctgctactgtggcgtgggagcatctacaaactcctgtggcgagagctgctctgcttccttgggttctacatggcgctgagtgctgcctaccgctttgtgctgaccgaagggcagaagcgctacttcgagaagcttgtgatttattgtgaccagtatgccagcctcatccctgtctccttcgtgcttggcttttatgtgacgctggtggtgaaccgctggtggagccagtacctatgcatgccgctgcccgacgcgctcatgtgcgtggtggcgggcaccgtgcacggacgcgacgaccgcggccgcctctaccggcgcacactcatgcgctacgcagggctctcggccgtgctcatcctgcgctccgtcagcaccgcggtgttcaagcgcttccccaccatagaccacgtggtggaggctgggtttatgacccgcgaggagcgcaagaagtttgaaaacctgaactcatcctacaacaagtactgggtgccctgcgtctggttctccaacctggcggcacaggcccgacgcgagggccgcatccgcgacaacagcgcccttaagctgctgctcgaggagctgaatgtttttcggggcaaatgtggaatgctctttcactatgactggattagcgtacccctcgtgtacacgcaggtggtgaccatcgcactgtacagctacttcctggcttgcctcattggtcgccagttcctggacccggctcagggttacaaagaccacgacctagacctgtgtgtgcccatcttcaccctcttgcagttcttcttctacgccggctggctcaaggtagctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgctggccaaagaagacatgcagttccagcggctggacggcttggatggaccgatgggagaggcgcccggcgacttcctgcagcgcctcctgccggcgggcgcgggcatggtcgcgggaggcccgctgggccggcgcctgtcctttctactccgcaagaacagctgcgtgtcggaggcgtctactggggccagctgctcatgcgcggttgtccccgaaggcgcggccccggagtgcagctgcggggacccgctgctcgaccccggcctgccggagcccgaggccccgccccctgcgggtcccgaaccgcttaccctcatccctgggcctgtcgagcccttcagcatcgtgaccatgcccgggccccggggtccggcgccaccctggctgcccagccctattggcgaggaggaggagaatctggcctgagatcttagagcccagccccctaaggacagggaaccaggtccctgcacggcacccacgcaggtgtcccggtctgcataagcctcgtgtgcctttgtaaagtccacctacacttttgaccagctctcgctgcccgcatgtgtttggcgctgtgctaggggcgggagttcttccagactcttggaccagcccgccctgaccaccagctctacttcccaacccccactgcctgagaggtctctatcagtgtcctgcctgaattctttccttcaagtgaagatgtgactgactacctcctcgagttgtcatgaggatgaaagaatggcattaaagcatttggtatacagtaggtgctcaataaattgctagtgatttttactcaaa

SEQ ID NO: 3493 - DNA, 1876 bp, Homo sapiens
atcagcagctgttgcttctgtttgttcccagctataactgtcatcagtggctaaactggcataaacaggcctctacaagtggaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaattaatcctttggctcgagggcaataaaattttgtcttaaagtagcagatcctgctccatcaaaccacaactcaattgggagtaaatgcaaacatgtatctatattgagagatagattttactctgattagaaagatgaaggagggatttggggataaacaatatgaaaattgctgagcagagctgagccagccagaagaaaaagcgatagcaagagaaactgtaggcagatgcaacggcaggataaaatagctatgccaggggtgtgatggggcctgaggagagcatggcatggagacagacacgtgcagggaaccaagtggtgggaggacaagcccactcagagtgttgccgaactgtagcaaatcagtaactataattagcacagcctcagcaatgacaataatgatcatattctgaaaaaaatattggtctctgcttaaaatggcttgaagtcctgatgagggtgacattccatttcataacaaatacttttggaatggacttgaccaacaacctagagattttctttcagttgaccgactttgatttccaaaggtggagttacttttgtgaacccccaaaatctgagacaggtctcagttaatttagaaagtttattttgccaaggttgaggatgtgcacccgtgacacagcctcaggtggtcctgatgacgtgtgcccaaagcggtcagaacagtttggttttatgcattgtaggaagacatgagacatcgatcaacatatgtaagataaacattggttcagtctggaaaagccagagatgactcaaagtggggagggggcttccgggtcataggtaggtaagagacaaatggttgcattcttctgggtttctgattagtctctccaaaggaggcaatcagatatgcatttatctcagtgaatggagcaatgactttaatagaatgggaggcatgtatgccgtaagcagttcccaacttgacttttccctttagcttagtgattttggggacccaagatattttcctttcacactttggataagtaagatgtgtgaccctgcaaggaataacaaaaattattctgcttatatattcttagaggatacattaatgtctcagtgattgtcattcatctttcacagcacccagcaaaatactcaataaatttgtgctaaaaacaaaa

SEQ ID NO: 3494 - DNA, 3532 bp, Homo sapiens
ataaacaggcctctacaagtggaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggttgtcactcttgctgtctataccttcttctttgcgtgcctgattggacgccagtttttggatcccaccaaaggctacgcagggcatgacttggatctttacattcccatcttcaccctcctacaattcttcttctatgcaggatggcttaaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccaccatcagggagaccagccagacaagcactttacagagcctgaccccacagtccagtgtgagaacttcccccatcaaaatgccactggtacctgaggtattgatcacagcagccgaagcaccagtgcccacatcagggggctaccaccatgattccgctacctccatcttgagctctgagtttacaggggttcagccaagcaagactgagcagcagcagggccccatgggatccatcctgtctccctcagagaaggagacacctcctggaggccccagtccccagacagtttcagccagcgctgaggaaaatatattcaactgtgaagaagaccctggtgatacctttctaaaaaggtggagtcttccgggattcctggggtccagccacacttccctgggaaacctaagtccagaccccatgagctctcagccagctcttttaattgacacagaaacatcctcagagatcagtgggatcaacattgtggctggctctcgagtctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgggcaggatactggagctgggaggctaatggggtccagagctgcataatggggatcggatgttggtactcctcccagggagctctcaggacagctgtttgtcgtgggctcccaagtgcctaggccatgccttacgactgctgcacttaccatttgtcatatgatggcacttgactacatatggctttagaaataaaataaccctcaaaacta

SEQ ID NO: 3495 - DNA, 1506 bp, Homo sapiens
gggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggttgtcactcttgctgtctataccttcttctttgcgtgcctgattggacgccagtttttggatcccaccaaaggctacgcagggcatgacttggatctttacattcccatcttcaccctcctacaattcttcttctatgcaggatggcttaaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggaaacagatgcctaagaatgagtggaagatggaagatataaaaatcccactccctcagcctcaattccagtgtgctaagagtgatcctggtggttaaaggtacaacactcgaatctttcaaaacaacttggctcctaaacacaagccaacaatctcatctgctgctcaactgaaaaacattctccactttttagcatccaggcatgtggagttcctaagaaatgcactttatta

SEQ ID NO: 3496 - DNA, 709 bp, Homo sapiens
gggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttag

SEQ ID NO: 3497 - DNA, 2878 bp, Homo sapiens
cagagagggctgactcagagtctgcacatggggtctgcttccaagttcttccaactgggcatatgcctccgccactctctgactgtcctttgcctgtgccaaggtttctgggaagaacaggaagttcagggatggcggaaaatgtttggcagattccctgagtccaaagccggagcacctgctcctgcctgagggcagagaggactggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccaccatcagggagaccagccagacaagcactttacagagcctgaccccacagtccagtgtgagaacttcccccatcaaaatgccactggtacctgaggtattgatcacagcagccgaagcaccagtgcccacatcagggggctaccaccatgattccgctacctccatcttgagctctgagtttacaggggttcagccaagcaagactgagcagcagcagggccccatgggatccatcctgtctccctcagagaaggagacacctcctggaggccccagtccccagacagtttcagccagcgctgaggaaaatatattcaactgtgaagaagaccctggtgatacctttctaaaaaggtggagtcttccgggattcctggggtccagccacacttccctgggaaacctaagtccagaccccatgagctctcagccagctcttttaattgacacagaaacatcctcagagatcagtgggatcaacattgtggctggctctcgagtctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgggcaggatactggagctgggaggctaatggggtccagagctgcataatggggatcggatgttggtactcctcccagggagctctcaggacagctgtttgtcgtgggctcccaagtgcctaggccatgccttacgactgctgcacttaccatttgtcatatgatggcacttgactacatatggctttagaaataaaataaccctcaaaacta

SEQ ID NO: 3498 - DNA, 721 bp, Homo sapiens
gaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaa

SEQ ID NO: 3499 - DNA, 2047 bp, Homo sapiens
atgacggtttcatacactctcaaagtggcggaggcccgcttcggaggtttctctggcctgcttctccgctggaggggaagcatctacaagctcctctacaaggaattcctcctctttggggccttgtacgctgtgcttagcatcacctaccggctgctgctgacccaggagcagaggtacgtgtatgctcaggtggcccggtactgcaaccgctcagcagacctcattcccttgtcctttgtattgggtttctatgtgactctcgtggtgaaccgctggtggtcccagtacacaagcatcccgctgccagaccagctgatgtgcgtcatctcggctagcgtgcacggcgtggaccagcggggccgcctgctgcgccgcaccctcatccgctacgcgaacctggcgtccgtgctggtgctgcgctcggtcagcacccgcgtgcttaagcgcttccccaccatggagcacgtggtggacgcaggtttcatgtcccaggaagagaggaaaaagtttgagagcctgaaatccgacttcaacaagtactgggtcccctgcgtctggttcaccaacctggcggcccaggcccggagggacgggcgaatacgtgacgatatcgctctctgtctacttttggaagagctgaacaagtaccgagccaagtgcagcatgctattccactatgactggatcagcatccccctcgtctacacccaagtggtgaccatagccgtctactctttctttgccctctccctggttggccgccagtttgtggagccagaggcaggggctgccaaacctcagaagcttctgaagccaggccaggagccagccccagccctgggagacccggacatgtacgtgcctctcaccactctgctgcagttcttcttctatgctggctggctcaaggtggctgaacagatcatcaacccatttggtgaggatgatgacgactttgagacaaatcagctcatagaccgcaacttgcaggtgtccctgctatccgtggacgaaatgtaccagaaccttccccccgctgagaaggaccagtactgggatgaggaccagccgcagccaccctacactgtggccacggcggccgagtctctgcggccctcattcctgggctccaccttcaacctgcgcatgagcgacgaccctgagcagagcctgcaggtggaggcgtcccccggatctggtcggcccgcgcccgccgcgcagaccccgttgctcggccgcttcctgggcgtaggggcgccctccccggccatcagcctccggaacttcggccgcgtgcgaggcaccccccgccccccgcatctgctgcgcttccgggcggaggagggcggcgaccccgaggccgcagcccgcatcgaggaggaatcggcggagtccggggacgaggccctggagccctgaggtctcgcctgcccccgcccggtttcccccacccactgccctccttccctcccgtgcccggtcctgccagccagctctattagagcagcttttcctgtgtgccttgaaggccagagcatttagggacagaacttgaaagagaagatggcgaaaagggcctgagccagggctgggaatgtgtccactttggtgggagagaaggtcggttgcttgggggacgtgaagctagaaaaataaatgagcccaggcatagaggactagagcccaggtgcacggttagcttcacagcaacagggagctaggccattggttctcaaacttaaggaaggatcagcatcacggaaggtcttgtcaaaagagtgctgggcaccactcccagcatttctggcacgttagatttgggatggcgcccaataacttgcatttctaacaagttcccaggtgatgctgtgctgcttgtccaggaaacacaatttgagagtcatgtgaaacgtgcttgaaggggtataccttaccctggtaaccttactcaaaagaagggtcagtgtgtgctgggggacttttgccttgtttgtaatgttaaagtttttgtttacattgagaatatattcaagtttttgtttaa

SEQ ID NO: 3500 - DNA, 2421 bp, Homo sapiens
agtttcaaaatattctgacaggacacagacagccctggctgaaaggagcacagagagaatacttcgagctcatgctgagagaaaaaggcgagtttgtcttttcttacctgagactgggcctgaagggagagtttcagttcttcattgacggttgctttcaagatgtacctgggaattacaccaagtgtgacctgtaacaattcaagcaaaaatgaattttccctgattctagagaagaatcccctggtggagtttgtggaagagctccctgctgggcgatcttctctgtgctactgcaacttgctctgtgggattatcagaggtgccttggaaatggttcatttggcggctgatgttacattcttgcaagacagactaaaaggtgacagtgtgacagaaataggaataacatttctaaaaaagcgagacgagaaaaaatatagagggaaaaaatgaagactagcacggaaaatgccacggggcggctagctgagttaatgttagctaaacatgtatagacatagaaattttgaattgcttcatagcatgagctttgaaaggtttataaatcagccagaaatttgaaatgcagggcatgaaggcttaaaggtttttttttccttttgcttataaatcacgcattttcaatctcatgtccacaaaatttcatatgcaaatagctccttacaagatagcaggcaggaattccacatcttacactatccatcctcagagaagctgttcattccattcacgtatggtaatgggaaaaaaaagcagcacaaatacaaacagttgtgtatttgtctctttgctgaaaaaaaaagaatgaaatgatatagcatagagtttcctatatatagacagtagtttctagatactgtatattgcattccttaaataaataattccatatttctaaaaaaatatgatttgatttttctcatgtattagcttggcttatagctttagccttctgacgctacccttgatttgtaatcaccaagtcaagctatttattcaatgataattttgaaacatttataaataacatttaattttaatttatttagttttaatatagctggcatcaaccaaattccttccttttctcatgaaatattgcttgatggtcaggccaggaaacttctaaaataaaggataaataatattctttgaaattactttcttaccccaaagcttattaattcagaatttctactatcattttcatcctctaaaaaatcttccaaaggatgttttctttgtgaccagaacacatttaaaattcaagtgtaccgaattaaatacacagtaatcttcaccagaccactggcacacaagggcggcctacaaggcagcccagaatctactgggctctgcagagagcccaaattgcaagtacaagttataattagtgtgataccaccctacggaattggagaaaatatttgtaaactatgtatctgacacccttgtgctattaataaccagaatatataaggagttcaaccaactccataggaaaaaattaaaattaataatccaattaaagatgggcaaaagatctgaatagacatttctcaaaagaagacatacacatacaaatggcaaacaggtatatgaaaaggtgctcaacatcattggtcatcagagaaatgcaaatcaaaactataatgagatattatctcaccctagttaaaaatggcttttatccaaaacaggcaatagtgaatgcttgcaaagatgtggagaagagggaactctggtacactgttggtgggaatgtaaattagtataaccactatggagaacggtttggaggttcctcaaaaaacaaaaaatagaatgatcatatgatccagcaatcccactgctggatatatacccaaaataaaggaaatcagtatatcaaagagatatctgcactcccatgtttactgcagaactactgacgatagctaagatttggaagaaatctaagtgtccttcaatagattaatgaaataaagaaaatatggtacatatacacaatggagtactattcagccataaagaagaatgagatcctgtcatttgcaaaacatggatggaactagaggtcattatgttcaatgaaatatgtcaggacagaaagacagactttgcatgttctcatttatttgtaggagctaaaaattaaaacagtggactcatggagatatggagtaaaatgatggatatcagaggctgggaagggtagtttcaagaggagtggagatggttaatgggtacaaaaatatagttagatagaatgaataagatctgggtcgggcatggtggcacaagcctgtaatctctgcactttgggatgccaaagtgggaggattgcttgagctcaggagtttgagaccagcttgggtaacatagacccctgtctct

SEQ ID NO: 3501 - DNA, 1113 bp, Homo sapiens
tacaaaaacaaaacaaaaagacatggactgatacacctctaagaaacaggcaaaagaagagaaattgaagatcatattcttcatctatcaagcactatgtctcgccctgcacaccgaagaccagaataccataaaataaataaagatctctttgtccttacctatggagctctggttgcccagctgtgtaaggattatgagaaggatgaagatgtgaaccaatatttagataaaatgggttacggcattggaacgcggcttgtggaagactttttggctcgatcctgcgtgggaagatgccatagttattcagaaattatagacataattgcccaggttgctttcaagatgtacctgggaattacaccaagtgtgacctgtaacaattcaagcaaaaatgaattttccctgattctagagaagaatcccctggtggagtttgtggaagagctccctgctgggcgatcttctctgtgctactgcaacttgctctgtgggattatcagaggtgccttggaaatggttcatttggcggctgatgttacattcttgcaagacagactaaaaggtgacagtgtgacagaaataggaataacatttctaaaaaagcgagacgagaaaaaatatagagggaaaaaatgaagactagcacggaaaatgccacggggcggctagctgagttaatgttagctaaacatgtatagacatagaaattttgaattgcttcatagcatgagctttgaaaggtttataaatcagccagaaatttgaaatgcagggcatgaaggcttaaaggtttttttttccttttgcttataaatcacgcattttcaatctcatgtccacaaaatttcatatgcaaatagctccttacaagatagcaggcaggaattccacatcttacactatccatcctcagagaagctgttcattccattcacgtatggtaatgggaaaaaaaagcagcacaaatacaaacagttgtgtatttgtctctttgctgaaaaaaaaagaatgaaatgatatagcatagagtttcctatatatagacagtagtttctagatactgtatattgcattccttaaataaataattccatatttctaaaaaaa

SEQ ID NO: 3502 - DNA, 975 bp, Homo sapiens
aataaagatctctttgtccttacctatggagctctggttgcccagctgtgtaaggattatgagaaggatgaagatgtgaaccaatatttagataaaatgggttacggcattggaacgcggcttgtggaagactttttggctcgatcctgcgtgggaagatgccatagttattcagaaattatagacataattgcccaggttgctttcaagatgtacctgggaattacaccaagtgtgacctgtaacaattcaagcaaaaatgaattttccctgattctagagaagaatcccctggtggagtttgtggaagagctccctgctgggcgatcttctctgtgctactgcaacttgctctgtgggattatcagaggtgccttggaaatggttcatttggcggctgatgttacattcttgcaagacagactaaaaggtgacagtgtgacagaaataggaataacatttctaaaaaagcgagacgagaaaaaatatagagggaaaaaatgaagactagcacggaaaatgccacggggcggctagctgagttaatgttagctaaacatgtatagacatagaaattttgaattgcttcatagcatgagctttgaaaggtttataaatcagccagaaatttgaaatgcagggcatgaaggcttaaaggtttttttttccttttgcttataaatcacgcattttcaatctcatgtccacaaaatttcatatgcaaatagctccttacaagatagcaggcaggaattccacatcttacactatccatcctcagagaagctgttcattccattcacgtatggtaatgggaaaaaaaagcagcacaaatacaaacagttgtgtatttgtctctttgctgaaaaaaaaagaatgaaatgatatagcatagagtttcctatatatagacagtagtttctagatactgtatattgcattccttaaataaataattccatatttctaaaaaaa

SEQ ID NO: 3503 - DNA, 4254 bp, Homo sapiens
cgatggcgcggcggagacggagggaggaggggagccggcagagaagggtcagccgcggcggcagggcggcggcggcagcggcgcagctccgctccccgcgcgtctcccttccccgcgcccaggtagggcgctcagcctccgccgccaggatgcggccgcccgcctgctggtggctgctcgcgccgccggcgctgctcgcgctcctcacctgctccctggcttttggtttggcttctgaagatacaaagaaagaggtcaagcagtctcaggatttggagaaaagtggtatatcaaggaaaaatgacatagacttaaaaggaattgtattcgtcatccagagtcaaagtaattcttttcatgcaaagagagcagagcagttaaaaaaaagcatcttaaagcaggctgcagatcttacacaggagctccccagtgtcctcctccttcatcagctggctaaacaagaaggtgcatggaccatacttccgttgttaccgcatttttctgtaacatatagcagaaattcatcttggattttcttctgtgaagaagagacaagaatacagattccaaaactcttggaaaccctcagaagatatgacccctctaaggaatggtttttgggaaaagcattacatgatgaagaagctacaataattcaccattatgccttttccgagaatcctacagtttttaagtatccagactttgctgcaggctgggccttaagtattccacttgtaaacaagcttaccaagagactaaagagtgaatccttgaaatccgactttacaatagatttaaaacatgagattgccctctacatctgggacaaaggcggaggacctcccctgaccccagtgcctgagttttgtaccaatgacgtggacttctactgtgctaccacattccattcttttctaccgctttgtagaaagccagtgaagaagaaggatatttttgttgcagtaaaaacatgcaagaaatttcatggtgacagaatacctattgttaagcagacttgggagagccaggcaagtctcattgaatactatagtgactatactgaaaattccattcctactgtggatttgggaattcctaatacagatagaggtcattgtggaaagacatttgccattttggaaagatttctgaatcgtagccaggacaaaacagcatggttagtcattgtggatgatgatacattaataagtatctccaggctccagcacttgcttagctgttatgactccggcgagcctgtgtttctgggagagcgctacggctacggcctgggcactggtggctacagctacatcacgggaggaggaggaatggtcttcagcagagaagccgtcaggagacttctcgccagtaaatgtcgatgctacagcaatgatgctcccgatgatatggtcctgggaatgtgctttagtggcttgggaatccctgtgacacacagccctctcttccatcaggctcggccggtggattaccctaaggactacctttctcatcaagttcccatatcgttccacaaacactggaacatcgatccagtgaaggtgtatttcacatggttggcacccagtgacgaagacaaagccaggcaggagacacagaaaggttttcgagaggagttataaatcagggtgacctgtgcgcctagcctgcgcagggaatgaactggagactgtggcctcatcccactgtgctgtgctcacaacacttgtgtctgccacatggcattgggtgcttcctgactttagggggagattttatgtatggtattttttgacagaggaagaaaaggggtcacaggagaaacatttttttttctgggaaaaatcacttgcttttgacttatgcagttgttttaacacttagtgatgactgtgtattctccaagctgtgatacagcagtttttttttattgtcacagggaaataaatggtaccagaagtccctttcctgttctgtctcttcattgtaatggaagtttcagttgggcatgagcctggagagatgtgactgtctacagttctatttgtatatataaaaagaagactgaaagtcttttgacatggatattgtgaatggtatgaacttttaaaccatattattgatgatgaaaattatttcctgggaactcagtaggaataataccgtattaaggaataatactgtacataaaacatcatgaaaccctagatatgaaatcccctgaagtctgtaatcatggtggttatgttttgtctattcttttgctgtttgtgcctcataaaaagagaatgaggtcttctgctagagcttcgtattgctttggaagttcatctgtgttttatttctccctgaagccctatctttatggcttacttgtaacatgaaagtagtagatgctgccagaaaatagtgtcctcaatattttaaaacaatgttgacatgttttgttcaagtcagcaagctctatgtgagtctcaggaagtgaattaaatttggaccttatgttttactcttgttttttttttttttttaaatgttacttaatgactctctcctgactcaggagagaaaccccttgtggaaggacagcatggtgatcaggcaatttctctgggttcccaaagaatgacatttgaacacagtattttgaaacagctctagttttcaaattatatctttaatatatagtaatgtaacatattcagtattaatgtataaaaagcactctaattatataattcagtttttgtaaaggtatttgcataaaatttaatatgtcttaaactaattttggtaaattacttcttttttttctttttaataaaaactgttactcattaactttgcttataatgctttttatagcccagcacagaatttaaagccataccaccaaaagtacctgtgtgtgttaatatgtttttcttgtagcatagattgactatttgcaatagtattagtatttaccatttttccaaattagcaactaccagacctcacgtgttgcagtgataacacaatgcattggattcagttttgtgaaaatggattctgtggccatccaagggatgtatcagggatgatcagctgatgagaggctccagaaggatttctagatcgcttcaagcctatactgatggccttagctttgttcagtcattgtaactgggattgttgtcattgctaccgtggtagtcaccttcatgtcatctataatagtactcctggagagccctggctgcctacaccagtggaaaagagtctccagttctgctctggcctactaactgttaccactgagagaacaacatgttcatttgacatgattgaagctggcatccgtatatgaagatccttgtcaagctttcttctgtggtctgattagtgccttctactgataccggggcacctcctctggtacttttaagtgttttgttaattatatttactttttggaatggtgtaagcctaaccacaagtaaaagatctttgcctaagtttttgatttctcaaatattgtgttcattagtctagactgggaatggggaggggaaatggggaaaatgaatgaatgaaatcagaaaaaagtcagcggctcagtaaatacagtttaaagagagaataattacttcagagctacccttttaagagaaaaccatcagaaattgataatgtttatataaagtttataaagccattgtgttttgttatataacaaatcagagatgttattttagaatcgattcccatctaaagaactcaattttgagtctgacatttccaggaccagatattgtcttactcacatttcctttgctttgaaatagggctttccttccaaatggctatttttaggctagggatgttaacatcagggatttgtgtgtggaataactggaatgtcatttttgcttttaagccatttctgatgatatagccaaagcaggttgtctgactatgtaggatttttacatcttgaaactaaatcagaaatccagacatgaaaataacctttctagaatgcctaggagcagaaaacaataatagcatgctaaatcacaaatgatgctatgtatgggtatgtaaatatcagtgctgtctgcatttctgggtttattgaagacctcttgttgtatatatcctcaaaaattaatgtaattgacatcttcaagaatgtttctattgtcttccattcataatcagagatgtaatttgtatggactaaataaaaactttattatgtaatgaaaa

SEQ ID NO: 3504 - DNA, 3652 bp, Homo sapiens
ggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtgggttgtgagtgctggtaagacctgctagccaacattcagctgctctgtcctctccatgcctggccggcccggcccatgcctgttcttttctcccctgtgctgccgccgcccgtggccgcccctctcctgaacttaccgccactcaggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgctccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtc

SEQ ID NO: 3505 - DNA, 3522 bp, Homo sapiens
ggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtgggttgtgagtgctggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgctccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtcct

SEQ ID NO: 3506 - DNA, 5737 bp, Homo sapiens
agaggtgttcccagtatggccgatctccataggcatactggcccttaagtcaggactcagttccacgggcccttaagtcaggactcagttccatgggtgctggcccttaagtcaggactcagttccacgggtgctggcccttaagtcaggactcagttccacggaggctgttttgttggcgctcttgcctcgcctctggccctaggtgcccactgagctacactttcctcacataggacatcccttcatcttcgcagagccctatggtaacctccagttgctaaaatggcaggatcgttgaaacttccagctcaacctccctattgtaaagacgaggtcaaggagggcaatcagcatgacccaggtccccgtggagcacctgccggacacgtccaggccgccaccctcccactcccatgtgctgccccagcttctgctccccatctgggaaccaccctccactctcccacagggaagtgcttgcttccctctgaggctctgagggcacccggggagggcagggcacagccttttgtgtctctacttgccgagacgcctgagatctgaggttggtcacagatatggtgcaagtgtcaggatgggagttgtgaccacggcaggcctgggccctacactcacacacactgcccacgccgcgtcctgcctctccacgaagtcccccttgtgcctccacccatctcctcctccagcaccccattcttccccgtgcttgcctccatctcctgggctctcctgggtgtggccaagccactcctgcacctttgtgctgattcttctgcctgacccaaggtcctagaagccattctggggtccttgttagagacagcctgcgaccacagacaaacaccgccctcctccaagccccaggcagaagcagcaggctgcgagaggggaccagtgctggccaaccttgcagccccgtctcagactggggcccagagctgggggcaggtgcagcccacccgctgcctggccccaagcccctgcccagcccaggcatcacatcccacgacctgccccctgccggccagctggcgttctccaggctgggggctctctgtgttctgcttgataactgcctggtaattagctccacgattttgctactatgcttataatagcctccattaaagttatggggttttcaagccataatggcttccagagtaattaatgcacaactgggtttattgctgagtttatttttagaggttttctccctctctccccctcccttttctctcatagatgttttgaccaaaaagactggatgggagcagaaggcaccccacggcacccttgcccacaggccccatcctcccctctcttcccttcccgcccctccttcctgcttcagcctccaagcaggtgctagggccctgcagtgggggcagccattgcagaggagggtggctgtggtccaggccagaggaagcatttggcctgtgtgtgccccttacccaccctgcgcctggcccaggttcgagaggcttggaggcctgggacctcttatcctatgcccccgatgacagcatagagccagatggcctggactcaattccagctccaccatttcctaatggttgacctcaggcaagttactccccttctctggcctcgatgaacccacagggaccacagccatgcctactgcacagggctgctgtgacgttgcaggagcaggtgcatgtgaagagctgagcctcatcttcggacatctctcatgctatagggaagtttgtataaacaacagtgcaagcgggggctgagaggctgccccaaaggaaaggcagtggcccacagggactgagctggcaggacactcatcttctctccttggctttctccatcctggtattagaacctgcaccaacaccaggagcacttgagaaagctccttcgagagtctctgagaacacagaagaaatcttcctggacatttctgaagccccagccaggcccagcctccccatccttcatcagatgtggcctaagatccaaacgtgtcttggccaaagaaccaaaacgtgtcttgacacgcagccccatgcagccccagcagtggcctgggtgtggagggacaggctaaatctgggggatgtggcatgaagtcacttgcatctcagaccacaagacccagcaggcatcccgtgtggggttctaggctctgtccctcactgggccagcaaagaggagtttacgggcggacacagacacacacggcctagaatgtccactaggggaactacgtgcctgtgacgttgaaccccagtgggtcttccactccccggggaatgggtgggggagactctctggatggagtgggcctctgatggcggggtgtgggcaggggatgccggccgtcctgggaaaccacagtgctccttaatggaggggatgccggccgtcccgggaaaccacagtgctccttaatggaagacaaatcctggtcttccacaggcgtcagaactatttggagagaggacccggtgaggagaggaaaacacgctattttggaaactcaggggctaaaaaccctcctcggccatagcactcgactctgcctgaaatggtgagcacacgtgagctggggcaggagcaggcagcatggcccccaggtgaggtactgtccgtatccaacactgggcactgggacgggtgggcacagtgaggctggctgggctgcccgaggctgcctgccctccccaccacccccacgggtccctgctgcatcatgcatggtgctcagcacagaagtgaaaagggaggagaagaggatgtgacagtttccaaggcggtcaggaggtctcttcgcccagtgtccttgccatgtgagagaacggttcccagagatgctaccagtggaccctctgcaggactgaggaatcccagtggctcattctcctcacttgggccccctgctgttctcattttggaggactgtctcccctcaatgtggcagcccctgcggggacccctcttcttgctgctgcccagcccagcacctggtgctctgtcctgcacagagcggtgctccacaaggatgtcctattgacacggaagaggaaggcactctcgtacttccccccagggaccatcccagaaacatctcttctttgtcctcaaaagactgtcaccaaaatgcaaattgaaaccacagtgagatactatctcacaccagtcagaatggctattactaaaaagccaaaaaatattagatgctgatgaggctgcagagaaaaggcaacacgtatactctgttggtgggaatgtaaattagttcagccactatggaaagcaatttggagatctctcaagaacttaaaacagagctgccattctagccagcagtcccattactgggtatgtatccaaaggaaaataaagtgtttcacaaaaaaaacacctgcacctgtatgttcatcgcagcactattcccaatagcaaaggcatggaatcaatctaggtgcccatcagtggtgaactgggtaaagaaaacatggtgcatatacagcaaggaatactacacagccataaaaaaggacaaaatcatggcctttgcagcagcctggatgcagctggaggccattatcctgagcaaattgacacaggaacagaaaaccaaacacgatgcattctcacttatgagtgagagctaaacactgggtactcatgactgtaaacatgagaagaatacacactgaggactctcaaaggaagaacggctgaaaaacgccctgttgggtactatgctcatacctgggcagcgggattcatcatactccagatctcagcatcacatgcaatatgacccataacaaacctgcacatgtgcccccaaatctaaaatgttgaaattatttttaatataataattcgtggtccatatatggttaaaaaaaagaaaaaagagagagagaaaataaaacctctcacccctttatccaggctttgataagtagctggcattttagggctgcacgggagttaccctgtttaattctgagaatgaccttatgaggtagggatccacagtgccccattttatagatgggaaaactgtggcatggagaacggaaatgacttggcaaaggtcttacagcctgtgggtggcacagttgggatttaaacctggtgtctctgcagtctgtgcttctgacccctgcaccctactgactttcataaatggagcagagccatggccctgtgcctgtgggaaggacagagcccattccactctaacaggcagacaaaagaggtcctcaggtgatggacagttgaggctccattgtggaacccccgatgctgtgtgtcccagagcagggcccagccttgctggcatccattcctatacctgggtctctggctatccgcttctgctctctcttgcaggtgtccaccccccagggttcctgacccctgcccctggacagcgaccccttctcagactccagttgggccggactctccaaacctgcttccgcaatgggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcagggcagatgtgggcaggagtggagggcgtcgtcaccacagtccccttcccactgggccacctgaaagtatccaggcattaactttcacccacgcagctgggtccttctgccaccagactcttcagagggtgtcaccttccaaacatcttgctgatttttctgctggcagtgacg

SEQ ID NO: 3507 - DNA, 1271 bp, Homo sapiens
agactccagttgggccggactctccaaacctgcttccgcaatgggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcagggcagatgtgggcaggagtggagggcgtcgtcaccacagtccccttcccactgggccacctgaaagtatccaggcattaactttcacccacgcagctgggtccttctgccaccagactcttcagagggtgtcaccttccaaacatcttgctgatttttctgctggcagtgacg

SEQ ID NO: 3508 - DNA, 1641 bp, Homo sapiens
gggaccggaaatcaagtctacaaggcgggggggtgcacagatgaccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 3509 - DNA, 1120 bp, Homo sapiens
agaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcggacagagtctcgctgtgtcacccaggctggagtgcagtagcgcaatcttggcttagcgcaagctccgcctcccgggttcacaccattctcctgcctcagcctcccaagtagctgggactacaggcacccgctaccacgcccggctaatttttttgtgtttttagtagtgacgggg

SEQ ID NO: 3510 - DNA, 5068 bp, Homo sapiens
tcggcgcagcgccatggggagcccccgggccgcgcggcccccgctgctcctgcgcccggtgaagctgctgcggaggcgcttccggctgctgctggcgctcgccgtggtgtctgtggggctctggactctgtatctggaactggtggcgtcggcccaggtcggcgggaaccccctgaaccggaggtacggcagctggagagaactggccaaggctctggccagcaggaacattccagctgtggatccacacctccagttctaccatccccagaggctgagcctcgaggaccacgacattgaccaaggggtgagcagtaacagcagctacttgaagtggaacaagcctgtcccctggctctcagagttccggggccgtgccaacctgcatgtgtttgaagactggtgtggcagctctatccagcagctcaggaggaacctgcatttcccactgtacccccatattcgcacaaccctgaggaagcttgctgtgtcccccaaatggaccaactatggcctccgcatctttggctacctgcacccctttactgatgggaaaatccagtttgccattgctgcagatgacaacgcggagttctggctgagcctcgatgaccaggtctcaggcctccagctgctggccagtgtgggcaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggttcagctttcaggagtacatcaagattgaccagcctgagaagcaggggctggagcagccaggttttgaggaaaaccttctagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggaggtaccagctacagcgcattgtgaacgtggaaaagcgtcaggaccagctacgtgggggtcgctacctcctggagcttgaactgttggaacaaggccagcgcgtggtgcggctctcggagtatgtgtctgcacgaggctggcagggcatcgatccagctggtggggaggaggtcgaggcccggaacctgcaaggcctggtctgggacccacacaaccgtaggagacaggtcctgaatacccgggcccaagagcccaagctgtgctggcctcagggtttctcctggagtcaccgagccgtggtccacttcgtcgtgcctgtgaagaaccaggcacgctgggtacagcaattcatcaaagacatggaaaacctgttccaggtcaccggtgacccacacttcaacatcgtcatcactgactatagcagtgaggacatggatgttgagatggcactgaagaggtccaagctgcggagctaccagtacgtgaagctaagtggaaactttgaacgctcagctggacttcaggctggcatagacctcgtgaaggacccgcacagcatcatcttcctctgtgacctccacatccacttcccagctggagtcatcgatgccattcggaagcactgtgtggagggaaagatggcctttgcccccatggtgatgaggctgcattgtggggccaccccccagtggcctgagggctactgggaggtgaatgggttcgggctgcttggcatctacaagtctgacctggacaggattgggggcatgaacaccaaggagttccgagaccgctggggcggggaagactgggagctgctggacaggatactccaagcgggcctggacgtggagcgtctctccctcaggaatttcttccatcatttccattccaagcgaggcatgtggagccgtcgccagatgaagacgctgtagccggagggtgtccgcggggcccagcactccccgctctggactagcagtggctccccagggccctgctactgttcagggatggggagtggggtgacggctggaccccaagaggcctcgaagctgacggcccactccacctggagctgtcccctcacagaggcaggttccggggctcctgtctctgcctcctgggccttcagaagggaggactttgagagagaggccaggagggaccacttgctcagtcgagaacgggaagagctcctgagaaggacgggtcaggaaggagagatctgactgagcgacaccatcctcatccatgaaggtgcacgcccacatcccccaagcgctcctcacgccaagcgctgaccaccagaccctcttctagtggacatattttattggggggcggggattttaaaaacagaaaaccgaaactgctgtccagagcgggggtgaggttgtgcactgagggactgtccccacgtgcaggcctcccgcccactcctatgtcccttgggcgttgtccctggccgcgggactggtcccacgtggggcaggtctctgctccaccccaggctcgtgccttccagagacacacatctcccagtagccaccaaacagctggccactgattagggcattaacttcctccggatggctcacgtcagaccagaagcacagaacgggctgtttctggtgcttgggcattgggaggtggggagctggcgggcagggggcttgccactccctggcactggacattgaggcctgcagaacaggcagggtgatgaaggcaggggagagaagccctttcccttaccggcgtgcctgtgggtaaggcctcccgagaggacatggagaagaggtaaagaggatgtggacatatctgtcaatttccttaggcaagaagcgggtgggggctggacagaaagggacgaaaagggaagtggaagctgtgagcctcacagtccagctccactgcagacctgcccttctgcagggagagccctggccacccggccttgagtggaagaagaggaaagggtgtacgggggcaaaaccctggacagggagcaggataagaagggggcgggatgagaggtttggggaggtgaggacattgccctgagatatcccctggaggcagggagaggagtgggggcaggaggaactgaagaggggggcagtttcagggaaaatagcccttagcctttttagtcgatgccaccctttctgtcacctggagaccttgtacttctcttgcactaataaccccggtgcttttgtggctgggggtttttctgttgctgctgctgcctccaccactgctgtgaattcacccatggtgcattggacactggatcttgaactccagagtctgtttagggaggtgagcacagggctgggggaggtgcggcggggcccagaagaccaggccactgagcccgcgctccaggctgtgacggtccaaaccacggcactggagctgcagggtctgcctagtgggctctgcattccccgagagcacgagtttggcacatgggagaatggagcccgtggagaaccttctggggggtcggggagaatccctgcctccctttaaggaatcatgaaggacagagacttttgagattgtggcttaggaaggccatacctgctccctgggctgtggctttttctggtccctgctgaggccgactggcccctggagaaggatggtggggcataggctagggctgcagttggccagtggggctgccagtttctttctgggaccactctcgtcctcgggcattgcactggaaggctggaaccagcccaaactgcccacctgcttcacttccaatgactaggagccagcccagcctcctgccctgcccacacccctgcgccctgggccagtgccttgcgtttgatgttacctccacaccatctgccttaagaggaagggccgggcaaggcccctactccctagagaaatgtcttgggtaggagagggtgtgggatggtgggaggggaagcattaaatacagcaacttcttagaaaaaaaaaaa

SEQ ID NO: 3511 - DNA, 433 bp, Homo sapiens
tgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaaatgagtatgcctgccgtgtgaaccatgtgactttgtcacagcccaagatagttaagtgggatcgagacatgtaagcagcatcatggaggtttgaagatgccgcatttggattggatgaattcc

SEQ ID NO: 3512 - DNA, 1027 bp, Homo sapiens
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcat

SEQ ID NO: 3513 - DNA, 1715 bp, Homo sapiens
gcacgcgtttaatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacaatcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggcccgctgtactttgaatgacaaataacagatttaaaattttcaaggcatagttttatacctga

SEQ ID NO: 3514 - DNA, 1220 bp, Homo sapiens
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctg

SEQ ID NO: 3515 - DNA, 1081 bp, Homo sapiens
gggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatat

SEQ ID NO: 3516 - DNA, 604 bp, Homo sapiens
tggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaattgtttttgatccatggtttgctgaatccacagatgtggagcccctggatacggaaggcccgctgtactttgaatgacaaataacagatttaaaa

SEQ ID NO: 3517 - DNA, 2670 bp, Homo sapiens
tcataaacaactccagctcttggattacgtcgggcaacataacagcaggcacggaattctctctgcttatttagaacctagtctgaagcaagcttttttttttttttggttaagtcaaaagtgaaactggagagggaaagctgagggaacaataagaggattaaagattagctatgacacatggcttggaaattaacctttaaccaaacatcttataagtaacgccagcgcagcttcccttgtgaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggcaagattccagcatggctgcagggaaccctgctccgcaatgggcctgggatgcacacagttggggagtccagatacaaccattggttcgacggccttgccctgctccacagcttcaccatcagagacggtgaagtctattacaggagcaaatacctgagaagcgatacctacaacaccaatattgaggcaaacaggattgtggtgtctgagtttggaacaatggcctatccggacccctgcaaaaacatattttccaaagctttctcctacttgtctcacaccatccccgatttcaccgacaactgcctgatcaacatcatgaagtgcggagaagacttctacgcgacctcagagaccaattacatcaggaaaatcaacccacagactctggaaaccctggagaaggttgattatcgtaaatacgtggcggtaaatctggcaacgtcacatccccattatgatgaggctggaaatgttctaaacatgggcacatccattgtggaaaaggggaagacaaagtatgtgatttttaagatccctgccacagtaccagagggcaagaagcaggggaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagaatgagctgggcctcctgcctggctttccacagggaggagaagacttatatccacatcatcgaccaaaggaccaggcagcctgtgcagaccaagttttacacagacgccatggtggtcttccatcacgtcaacgcctacgaagaggacggctgcatcgtgtttgacgtcattgcctacgaggacaacagcctctaccagctcttctacctggccaacctgaaccaggacttcaaggagaactccaggctcacctcggtccccaccctcaggaggtttgccgtgcccctccacgtggacaagaatgcagaagtgggcacaaatttaatcaaagtggcatctacaacagccacggccctgaaggaagaagatggccaagtctactgccagccggaatttctttatgaaggcttagagcttccacgggtcaattatgctcacaatggaaagcaataccgatatgtctttgctacaggagttcagtggagtccaatcccaaccaagataataaaatatgacattctcacaaagtcatccttaaaatggagagaggacgactgctggccagcggaacccctgtttgtgcccgcgccaggtgccaaggatgaggatgacggagtaatcttatcagccattgtctctactgatccccaaaagctgccttttctgctcattctggatgccaaaagctttacggaattggcccgtgcctctgttgatgtcgatatgcacatggatctccatggattattcattacagacatggactgggacacaaaaaagcaggccgcttctgaggaacagcgggacagggcttccgactgccacggggctcctctgacctgatggtgttggggtttgggtaggggaggggagctcggctgtcagaactccatggatatgtttctttggatggaggggagggcctttgttaccttttgcacttattctttctgtgggtgctttgacaagggcatggcaagagagcttgtcagtatcatttctttcattttattttggctgtaaaaattttgtttgaaagtcaaacatttgaacatcaaatatgtattgattagatccagtccttctaagaaacctcctttcctttaacaaaaagaccttgaccatgaatcagagattgtattcaatgacattatcatcatttttagaacgagccactaacctattagagaagaggcagataattatttatcattgtgccttcctctgtctctttctctttcctttgctccctcccatgtttctggtggactaaattgtgtatctgggagttctcactttctagccaggcctgatgagttaagttacatgaccaggaaggttatgccactttgtggtcattccatgcaagtcatggcgtaatataaaataataaaaactttaaagtctg

SEQ ID NO: 3518 - DNA, 1857 bp, Homo sapiens
gtgaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggcaagattccagcatggctgcagggaaccctgctccgcaatgggcctgggatgcacacagttggggagtccagatacaaccattggttcgacggccttgccctgctccacagcttcaccatcagagacgagctttctcctacttgtctcacaccatccccgatttcaccgacaactgcctgatcaacatcatgaagtgcggagaagacttctacgcgacctcagagaccaattacatcaggaaaatcaacccacagactctggaaaccctggagaaggttgattatcgtaaatacgtggcggtaaatctggcaacgtcacatccccattatgatgaggctggaaatgttctaaacatgggcacatccattgtggaaaaggggaagacaaagtatgtgatttttaagatccctgccacagtaccagagggcaagaagcaggggaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagaatgagctgggcctcctgcctggctttccacagggaggagaagacttatatccacatcatcgaccaaaggaccaggcagcctgtgcagaccaagttttacacagacgccatggtggtcttccatcacgtcaacgcctacgaagaggacggctgcatcgtgtttgacgtcattgcctacgaggacaacagcctctaccagctcttctacctggccaacctgaaccaggacttcaaggagaactccaggctcacctcggtccccaccctcaggaggtttgccgtgcccctccacgtggacaagaatgcagaagtgggcacaaatttaatcaaagtggcatctacaacagccacggccctgaaggaagaagatggccaagtctactgccagccggaatttctttatgaaggcttagagcttccacgggtcaattatgctcacaatggaaagcaataccgatatgtctttgctacaggagttcagtggagtccaatcccaaccaagataataaaatatgacattctcacaaagtcatccttaaaatggagagaggacgactgctggccagcggaacccctgtttgtgcccgcgccaggtgccaaggatgaggatgacggagtaatcttatcagccattgtctctactgatccccaaaagctgccttttctgctcattctggatgccaaaagctttacggaattggcccgtgcctctgttgatgtcgatatgcacatggatctccatggattattcattacagacatggactgggacacaaaaaagcaggccgcttctgaggaacagcgggacagggcttccgactgccacggggctcctctgacctgatggtgttggggtttgggtaggggaggggagctcggctgtcagaactccatggatatgtttctttggatggaggggagggcctttgttaccttttgcacttattctttctgtgggtgctttgac

SEQ ID NO: 3519 - DNA, 2930 bp, Homo sapiens
aagctgcgtcctctctttgacctgtcagtgagggagggacagtccaggcagttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgcaatttgtgaagctgccaaagcgttagacaagcaccaagcccacttttgtctgcctgcacccaactgcaatgagcctatgtatgtcaagttggtggagtcccatggtgctgaacaccaactcaccctaattaaggttgatgacaacaagaaaccagaggaatgggtaggcctctgtaaaactgagagggaaacccccgaaaagtggttggctgcagttgtgcagtagttaaggactaggtcaaagaatcttaagtcaaggatgtcatcgaagagtatttcaaatgtaagaaatgaacaaataaaactttggcactcatgtttcttaagaaaaaacaccacaaagcagaattcataatataactatggttatagatatttattttttagggctcttacttgaaataattaagaaagtattgatacaaccttttgaagagggttttaaatttcatttattggatatatcttcctctaggtaataataagaatacacgaaataaaaa

SEQ ID NO: 3520 - DNA, 2903 bp, Homo sapiens
gacctgtcagtgagggagggacagtccaggcagttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgcaatttgtgaagctgccaaagcgttagacaagcaccaagcccacttttgtctgcctgcacccaactgcaatgagcctatgtatgtcaagttggtggagtcccatggtgctgaacaccaactcaccctaattaaggttgatgacaacaagaaaccagaggaatgggtaggcctctgtaaaactgagagggaaacccccgaaaagtggttggctgcagttgtgcagtagttaaggactaggtcaaagaatcttaagtcaaggatgtcatcgaagagtatttcaaatgtaagaaatgaacaaataaaactttggcactcatgtttcttaagaaaaaacaccacaaagcagaattcataatataactatggttatagatatttattttttagggctcttacttgaaataattaagaaagtattgatacaaccttttgaagagggttttaaatttcatttattggatatatcttcctctaggtaataataagaatacacg

SEQ ID NO: 3521 - DNA, 2598 bp, Homo sapiens
gcctctttcctgaaggttgctgggagcttctgaagctttgtgtcctgtgtggctcagatgagatagcaattccgcagagtcctggaagttaaagaaggctgagttaggattgtttcctcatggtcagggaaacagccttcacatttgtatattttatgcaatatttaaggcaggattcagggacttggtattctttgggatttgcaataagaagaatattcaatatttaggcttttctaaattgaaaaatcactgccacacgttctaatgtaattgtttggtttctctatttgcattttgcggggactgccttaaaactcatttatgttttatagccttctattatagttaccattgttacatgattttatgtatagaaattggctgatctagagctttcagaaatcatactaatatgcactataaattttaaaattacttaatgtagtaatttaatgtttgcagtatgcaagggaatgtattacgtactggaaggagagaggagacaaacaccagaccctgtactcaaggagtactggtagtatcatttatcatacaagacagataagataaggtccatatgagagctataaacagatgctgtgagttcagactaaggagaatcagttcttgctgtaggtaaggggaatgctgtgtttataaagcaaatgacatggcaactggatcttgaaggatgagttagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaat

SEQ ID NO: 3522 - DNA, 1983 bp, Homo sapiens
aaggagaatcagttcttgctgtaggtaaggggaatgctgtgtttataaagcaaatgacatggcaactggatcttgaaggatgagttagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaac

SEQ ID NO: 3523 - DNA, 2493 bp, Homo sapiens
gggaatgctgtgtttataaagcaaatgacatggcaactggatcttgaaggatgagttagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggaaacttttccaagcctgttattaatcagtgacttgtcctgcttttcatcatatacagtgatgatttttctcatatagagtggagctgtcctctccagtacctggaacaatgccagccacatagtagatgcccaataaatatttagtgaaagagtgaatggaagcaagaggtgacatgattctgggaactgtgtgtagtttggttactcttgtgagtagatgtgaggaaacaagatcctttcactctcaatgtgtctacactggcagaagaattgctaatatgtgtttaggggtgtctgtattcacactatgccaacccagagtaataaatgggtccatacatgcttgtggataagaatggctttagaatttcccttagtaaggatcattacacaacagtccaaaggactgttgtcacgtggtcctatttgtgctctcaaattcttgctctttaaaaatttttttttaaagaaacggtattaatcctaagcaaaaagaacaaagctggaggcatcacgctacctgacttcgaactatactacaagcctacagtaacaaaaacagcatggtatgggtaccaaaacagatatatacaccaatggaacacaacagaggcctcagaaataacaccacacatctacaaccatctgatcttagacaaacctgataaaaacaagaaatggggaaaggattccctattaaataaatggtgctgggaaaactggctagccatatgtagaaagctgaaactggatcccttccttaca

SEQ ID NO: 3524 - DNA, 2497 bp, Homo sapiens
gtataaagaggcaggctgcggactcggagcagctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgctgcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgaga

SEQ ID NO: 3525 - DNA, 1206 bp, Homo sapiens
agctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaaccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgctgcacaggaaaagtaattcagatgttaatgccacttgaagaagttggtaggctagcaaagaggatgagacatgaactgtcataaaggactcagcaaccag

SEQ ID NO: 3526 - DNA, 2050 bp, Homo sapiens
gggctgggggcgggctcctagacggccgcgcgcccgggaacccggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaa

SEQ ID NO: 3527 - DNA, 1537 bp, Homo sapiens
acagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgc

SEQ ID NO: 3528 - DNA, 1802 bp, Homo sapiens
acaagtctttccgcctccccagcccgcccgggagctgcgagccgcgagctggattatggtggcctgagcagccaacgcagccgcaggagcccggagcccttgcccctgcccgcgccgccgcccgccggggggaccagggaagccgccaccggcccgccatgcccgcccctcccagccccgccgggagcccgcgcccgctgcccaggctggccgccgccgtgccgatgtagcgggctccggatcccagcctctcccctgctcccgtgctctgcggatctcccctgaccgctctccacagcccggacccgggggctggcccagggccctgcaggccctggcgtcctgatgcccccaagctccctctcctgagaagccaccagcaccacccagacttgggggcaggcgccagggacggacgtgggccagtgcgagcccagagggcccgaaggccggggcccaccatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggtggaagatgtggccacgtcccaagacgactgttacatgccatctcacagtcatccacgggcactgttatgggagctgttatcatggagggcttctattgtctttgatcgggcccgaaaacgaattggctttgctgtcagcgcttgccatgtgcacgatgagttcaggacggcagcggtggaaggcctgtcaccttggacatggaagactgtggctacaacattccacagacagatga

SEQ ID NO: 3529 - DNA, 5847 bp, Homo sapiens
acaagtctttccgcctccccagcccgcccgggagctgcgagccgcgagctggattatggtggcctgagcagccaacgcagccgcaggagcccggagcccttgcccctgcccgcgccgccgcccgccggggggaccagggaagccgccaccggcccgccatgcccgcccctcccagccccgccgggagcccgcgcccgctgcccaggctggccgccgccgtgccgatgtagcgggctccggatcccagcctctcccctgctcccgtgctctgcggatctcccctgaccgctctccacagcccggacccgggggctggcccagggccctgcaggccctggcgtcctgatgcccccaagctccctctcctgagaagccaccagcaccacccagacttgggggcaggcgccagggacggacgtgggccagtgcgagcccagagggcccgaaggccggggcccaccatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggtgctgcctccgctgcctgcgccagcagcatgatgactttgctgatgacatctccctgctgaagtgaggaggcccatgggcagaagatagagattcccctggaccacacctccgtggttcactttggtcacaagtaggagacacagatggcacctgtggccagagcacctcaggaccctccccacccaccaaatgcctctgccttgatggagaaggaaaaggctggcaaggtgggttccagggactgtacctgtaggaaacagaaaagagaagaaagaagcactctgctggcgggaatactcttggtcacctcaaatttaagtcgggaaattctgctgcttgaaacttcagccctgaacctttgtccaccattcctttaaattctccaacccaaagtattcttcttttcttagtttcagaagtactggcatcacacgcaggttaccttggcgtgtgtccctgtggtaccctggcagagaagagaccaagcttgtttccctgctggccaaagtcagtaggagaggatgcacagtttgctatttgctttagagacagggactgtataaacaagcctaacattggtgcaaagattgcctcttgaattaaaaaaaaaaactagattgactatttatacaaatgggggcggctggaaagaggagaaggagagggagtacaaagacagggaatagtgggatcaaagctaggaaaggcagaaacacaaccactcaccagtcctagttttagacctcatctccaagatagcatcccatctcagaagatgggtgttgttttcaatgttttcttttctgtggttgcagcctgaccaaaagtgagatgggaagggcttatctagccaaagagctcttttttagctctcttaaatgaagtgcccactaagaagttccacttaacacatgaatttctgccatattaatttcattgtctctatctgaaccaccctttattctacatatgataggcagcactgaaatatcctaaccccctaagctccaggtgccctgtgggagagcaactggactatagcagggctgggctctgtcttcctggtcataggctcactctttcccccaaatcttcctctggagctttgcagccaaggtgctaaaaggaataggtaggagacctcttctatctaatccttaaaagcataatgttgaacattcattcaacagctgatgccctataacccctgcctggatttcttcctattaggctataagaagtagcaagatctttacataattcagagtggtttcattgccttcctaccctctctaatggcccctccatttatttgactaaagcatcacacagtggcactagcattataccaagagtatgagaaatacagtgctttatggctctaacattactgccttcagtatcaaggctgcctggagaaaggatggcagcctcagggcttccttatgtcctccaccacaagagctccttgatgaaggtcatctttttcccctatcctgttcttcccctccccgctcctaatggtacgtgggtacccaggctggttcttgggctaggtagtggggaccaagttcattacctccctatcagttctagcatagtaaactacggtaccagtgttagtgggaagagctgggttttcctagtatacccactgcatcctactcctacctggtcaacccgctgcttccaggtatgggacctgctaagtgtggaattacctgataagggagagggaaatacaaggagggcctctggtgttcctggcctcagccagctgcccacaagccataaaccaataaaacaagaatactgagtcagttttttatctgggttctcttcattcccactgcacttggtgctgctttggctgactgggaacaccccataactacagagtctgacaggaagactggagactgtccacttctagctcggaacttactgtgtaaataaactttcagaactgctaccatgaagtgaaaatgccacattttgctttataatttctacccatgttgggaaaaactggctttttcccagccctttccagggcataaaactcaaccccttcgatagcaagtcccatcagcctattatttttttaaagaaaacttgcacttgtttttctttttacagttacttccttcctgccccaaaattataaactctaagtgtaaaaaaaagtcttaacaacagcttcttgcttgtaaaaatatgtattatacatctgtatttttaaattctgctcctgaaaaatgactgtcccattctccactcactgcatttggggcctttcccattggtctgcatgtcttttatcattgcaggccagtggacagagggagaagggagaacaggggtcgccaacacttgtgttgctttctgactgatcctgaacaagaaagagtaacactgaggcgctcgctcccatgcacaactctccaaaacacttatcctcctgcaagagtgggctttccagggtctttactgggaagcagttaagccccctcctcaccccttccttttttctttctttactcctttggcttcaaaggattttggaaaagaaacaatatgctttacactcattttcaatttctaaatttgcaggggatactgaaaaatacggcaggtggcctaaggctgctgtaaagttgaggggagaggaaatcttaagattacaagataaaaaacgaatcccctaaacaaaaagaacaatagaactggtcttccattttgccacctttcctgttcatgacagctactaacctggagacagtaacatttcattaaccaaagaaagtgggtcacctgacctctgaagagctgagtactcaggccactccaatcaccctacaagatgccaaggaggtcccaggaagtccagctccttaaactgacgctagtcaataaacctgggcaagtgaggcaagagaaatgaggaagaatccatctgtgaggtgataggcaaggatgaaagacaaagaaggaaaagagtatcaaaggcagaaaggagatcatttagttgggtctgaaaggaaaagtctttgctatccgacatgtactgctagtacctgtaagcattttaggtcccagaatggaaaaaaaaatcagctattggtaatataataatgtcctttccctggagtcagtttttttaaaaagttaactcttagtttttacttgtttaattctaaaagagaagggagctgaggccattccctgtaggagtaaagataaaaggataggaaaagattcaaagctctaatagagtcacagctttcccaggtataaaacctaaaattaagaagtacaataagcagaggtggaaaatgatctagttcctgatagctacccacagagcaagtgatttataaatttgaaatccaaactactttcttaatatcactttggtctccatttttcccaggacaggaaatatgtccccccctaactttcttgcttcaaaaattaaaatccagcatcccaagatcattctacaagtaattttgcacagacatctcctcaccccagtgcctgtctggagctcacccaaggtcaccaaacaacttggttgtgaaccaactgccttaaccttctgggggagggggattagctagactaggagaccagaagtgaatgggaaagggtgaggacttcacaatgttggcctgtcagagcttgattagaagccaagacagtggcagcaaaggaagacttggcccaggaaaaacctgtgggttgtgctaatttctgtccagaaaatagggtggacagaagcttgtggggtacatggaggaattgggacctggttatgttgttattctcggactgtgaattttggtgatgtaaaacagaatattctgtaaacctaatgtctgtataaataatgagcgttaacacagtaaaatattcaataagaagtcaaactactagggtta

SEQ ID NO: 3530 - DNA, 1333 bp, Homo sapiens
accatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctgctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggtgctgcctccgctgcctgcgccagcagcatgatgactttgctgatgacatctccctgctgaagtgaggaggcccatgggcagaagatagagattccc

SEQ ID NO: 3531 - DNA, 1408 bp, Homo sapiens
accatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctgcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggtgctgcctccgctgcctgcgccagcagcatgatgactttgctgatgacatctccctgctgaagtgaggaggcccatgggcagaagatagagattccc

SEQ ID NO: 3532 - DNA, 1465 bp, Homo sapiens
accatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggtgctgcctccgctgcctgcgccagcagcatgatgactttgctgatgacatctccctgctgaagtgaggaggcccatgggcagaagatagagattccc

SEQ ID NO: 3533 - DNA, 1236 bp, Homo sapiens
aatagataggagagcaagcctcaccaatggttcccttcatctatctgcaagcccactttacactctgttctgggtggtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggtgctgcctccgctgcctgcgccagcagcatgatgactttgctgatgacatctccctgctgaagtgaggaggcccatgggcagaagatagagattcccctggaccacacctccgtggttcactttggtcacaagtaggagacacag

SEQ ID NO: 3534 - DNA, 2824 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 3535 - DNA, 2993 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 3536 - DNA, 2843 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 3537 - DNA, 1712 bp, Homo sapiens
ctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaag

SEQ ID NO: 3538 - DNA, 655 bp, Homo sapiens
actgaaaagcggaggaagctctctggagaaacgccgtgaggccgctggcggggccttcctggtgtcagggttaccgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaa

SEQ ID NO: 3539 - DNA, 6134 bp, Homo sapiens
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaattttctaa

SEQ ID NO: 3540 - DNA, 5993 bp, Homo sapiens
atccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaat

SEQ ID NO: 3541 - DNA, 5982 bp, Homo sapiens
ggcgctgcgttggctgcggcctggcaccaaaggggcggccccggcggagagcggacccagtggcctcggcgattatggacccggccgaggcggtgctgcaagagaaggcactcaagtttatgaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaattttctaa

SEQ ID NO: 3542 - DNA, 140 bp, Homo sapiens
cagtggcctcggcgattatggacccggccgaggcggtgctgcaagagaaggcactcaagtttatgacatacaacagctgtgccagactctgcttaaaccaagaaacagtatgtttagcaagcactgctatgaagactgag

SEQ ID NO: 3543 - DNA, 862 bp, Homo sapiens
atgatgttgtgtttggagaaaagagagaagagaattgaataagtacatgaccccttggaagctgttttcagttgaggattttggtgagtagccacttgaaatcaagggaaattccatgaatagcaggagctgggaagaaaggaagaggaggaaggatcccaccacttttttcttcccatctaacaccgtgcttatgcaaagcatagtccatatgagatctgccttataaaaacttgctgaataaagcgaatggaagttaaattttggactttcttccataatagcttcaaattatggtgactttgttgcctatagagggccaggaaatacatttctttgagatcctagaatctgagtgtgtgctctacacaggatggatagagcgagcctctggcagttccatttatccagaggcaaaagcacgcctgccactggaggcgctcttgggttccaacaaagaacctatgttgcctaaggaaacagtgctttctcttaaaaggtacaatcttggctcctctgccatgaagcggaatgttcctggacatgtgcttcagagaccttcctatttaaccaggatacaagttacattgttatgcaattcctctgctgaggccctgtaaaaggagtgagttaggacagatgcagcaagatattaggacagatttcgcccattattcaggctgcacaacacagaaggaaacttgatttcaataagacccaattcttaacagtcttttctacccacttttacccataacttttccaaatttggttcaaattgtgcagagaaacaataaaatttttaaaaaggataaactggctagttaaaagtaaatggcatttaattaaaacaaatcttgca

SEQ ID NO: 3544 - DNA, 1763 bp, Homo sapiens
gatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaagtgagcgttgtgttttatgcacacttttaggtatccccagattagaatgtgtttatttgggttggagtatcactgactgtggcctctctgacttcaagtgcttggtgtaattcacatgccatctcctctgtgaagcctccttgtttctcccagtgaagcaggccacctggttctctttcctctcactccattttgtgcgtgctttcactctagcacttgccataccaaagggcaattatttatctacctatctgtatctccttgtgaaatttgtgctccacaaaccaaagactgtatttgttcattttataaacatttatgaagtgtc

SEQ ID NO: 3545 - DNA, 5473 bp, Homo sapiens
caccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaagctgctgctgaagggaaaggcagaagtggggaagacttttttcaaaagatcatggaggaaacaaatacgcagattgcttggccatcaaaactgaagatcggagccaaatccaagaaagatccccatattaaggtttctggaaagaaagaagatgttaaagaagccaaggaaatgatcatgtctgtcttagacacaaaaagcaatcgagtcacactgaagatggatgtttcacatacagaacattcacatgtaatcggcaaaggtggcaacaatattaaaaaagtgatggaagaaaccggatgccatatccactttccagattccaacaggaataaccaagcagaaaaaagcaaccaggtatctatagcgggacaaccagcaggagtagaatctgcccgagttagaattcgggagctgcttcctttggtgctgatgtttgagctaccaattgctggaattcttcaaccggttcctgatcctaattccccctctattcagcatatatcacaaacgtacaatatttcagtatcatttaaacagcgttcccgaatgtatggtgctactgtcatagtacgagggtctcagaataacactagtgctgtgaaggaaggaactgccatgctgttagaacatcttgctgggagcttagcatcagctattcctgtgagcacacaactagatattgcagctcaacatcatctctttatgatgggtcgaaatgggagcaacatcaaacatatcatgcagagaacaggtgctcagatccactttcctgatcccagtaatccacaaaagaaatctaccgtctacctccagggcaccattgagtctgtctgtcttgcaaggcaatatctcatgggttgtcttcctcttgtgttgatgtttgatatgaaggaagaaattgaagtagatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaacggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagagatcgatcttcagacattcctcactctcacagatcaggatctgaaggagctgggaataactacttttggtgccaggaggaaaatgctgcttgcaatttcagaactaaataaaaaccgaagaaagctttttgaatcgccaaatgcacgcacctctttcctggaaggtggagcgagtggaaggctaccccgtcagtatcactcagacattgctagtgtcagtggccgctggtagcagcaccctcttggcacatgcccgctgactaactgtaaagtggacacaggagatgtatgaacagccttcacagcacaccatccttagcactctgggtgtctggtatcaggaccaaagcattttattcgcacctgtactttatggcaaaaaggaagaagagagagaagatgttcttatgatgtcatacagaacaccaaatatggattacttttttaaaatggcagttggacagaatttgcaatataaggatagggctttatttcctgtttttatttacctatataacatatgcactgatgatttttttttttttttttttttttttttttttacttaaaatgaaggatgaattgacatctgggatgccagaagacttagaagttattttgtttgcttgttttgtttgggtatttggggatttttaaaaaataatcaaagtggaattttctggtactgctttaaaataattattgtggtctttcagcactttacacgttctaatttcttgtcctatggaagttctcgctgtctccatctctctcatttttgtgtcacctaatatgttggtacagataagagttagtcacatttttctgactgcatcaaacttttatttgaaatggtactggatcttagtttctgtgcagaatattctgtgattttgggaaatgtaagtgagtccacttgcttctggaccaattctgtttcatgtatgttagcatcctagaaacacctagcaatggacctagttcacagtaataggtgcaaagaaagaccaaatggactttgcagtattaaccctttgcagtcgtcatacttagctgctgcctgtaatgctaaaatgattttaatggttgtctggaggcaaagggctgttttttagtatattgccactaaaggacatttatttatatcaaacttttatttttagatattataagcatacagtacataattgatgaaattgatatttactagagatttatggtagagaatggacgacattcaataactggagcccgagattgtcactttatttaaaaagacaaataatcatctgacaagacagcactgttgccattataaggagaaatagattacaatccttatcatgtacacgttagctatgttccgtatggccacaggactttcctgaaaccgtatctgtctgcttgaagtagacttatgtttgttgagaatgaacaggcttatttgagcctccagggtggcagttcataaagacagctaagttctgaaggaaaaaaaaaatatatctttttaagtggctagagtcattattacaatcttatactgtgaaagtccaagaaatcaggcaacattgtttcctgggtcttttcagagatcttatagatttatgaagtgtttttaatccatgaagaaacactaaagtgcctttctttcttcaaagcaatattatttccaagtatattaatttgttagaaaactttcccataggaaatgttgtcaagttacctgtactgtaaagagttatttatgttcagtagtcaagattttctacatggacataaaccactctcacgtgctctcagcagaaggcattagataagcatatacaagaattgggtacttttatacaaatatgggataagaaatacttgcctgacacttttccatggctgagtctgaccattacagtaagaacaagaattgaagaggcattttgcacacagaaacattctcactttaaaaaatggtattggttaccttgaaggcatagataatgggcctgtcataaaattatcaattataactggcaccgagggactgccctttttaagctaaactaagccttatctgcttaaggatgttgaactgaatcactccctttactcatcctgtgcatatgtgtacaaatggtcatgtggatcatgtgatgatcatccatcttatttgattgtattaatgcatcatgctaaacatgtagtacaggttaacaataccagatttatgtcctgttcaacaactcagtactctaaatgttgttatgcttttaataagaccttcccagataataatcttggagctcttttcccagctgtctaccatgcatttgcaacaggaggaagatgtaatgaatatgcagtattaagttgatttatgaacagtgctttgatatgccaaagggaaaactgtcccacttaaattagattaagtagggtggctaaaaataaataaaaacactggaaattctttctctcactttctcttgatgcaatgaagggaatatgacactacagtatacagagttgttgttatatgatgcacaaaatattttgatgatttgaataaatgttaacttttaatctgcgccttaataatgactggttatctgtaaatatagaacagatacagattgtatttttctgtgggtttttgtccttttagtgatttttttccaaaaacgagagatggaattaacattgaaaatgggaaatttttctaactgaatcaattgttacatgaaaaataaatttatataacccctttgtattgctcttgcta

SEQ ID NO: 3546 - DNA, 3281 bp, Homo sapiens
ccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaagacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaattt

SEQ ID NO: 3547 - DNA, 3194 bp, Homo sapiens
tttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggct

SEQ ID NO: 3548 - DNA, 8811 bp, Homo sapiens
ctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgccaaaaaaacaatagataataaaccttagctcattgtctacttttgacaaacactcaggtgcctacaaacattctattatcttgagataatacatgttcctggttaatttacagattctgctgggtaacttttatgacttgatttaaggcagtggattttcatagcaaaatttattttgcacataatctgacaaacaaggaaaacagctaactgagctgaaaggtctaacactctcgggctccttaaccatcaagtgctgcccacacaattgctcctagccctgattccttgtctttgtcaggtagccttaacttatttaaaaccataagggtttgaccttttcatataaagacatctgtaacttctcttcaaaacaaaaatgaccctcactgttaacacaaaggacagttaccagtgtagggcactgagaaaggagatccaggagccactcagcttattgagcggacatgggtggcacagaaatggagtggtccatcagagaccaaatggtaagtcgtaaagcacattgcaggagctttcgttagtcatacgcctattaagtagtggtcgctattaccaaagcaaccaggacgttttgtgttctttatatgagtgctattttccacagtgtcatttattatgcaacgtggagtaaagagttgaaatcttcaccaaaataagggttcaggttaaagtacagaaacagaaacaaaacgattcgacatgaagttcccaaccatagcagcctaaccttctgctcttttctacctgcatggccttgctgttcctaaacattgtcttcatttcactggcgttgtatctgcctagtaccagtattagtgagactgtggattttatcagagttcaatgaaagaaagcttacccctgccctcactttgtgttttttatttttccccctttctcaagcaccacgtatttggacctgagaagtggcatagctgctaagttgacttttaataaaaaactgtttgtgcctgagggaaatatatgcctttttaaaaagtacctcagaacatgttcgtagatcgtctcatcggttttgtttggtgggactgggagttcagcaggaagtattgtctgtgtgtgatgacggggcagtattgccagtcggcaatgttgtatttgcattctttatccctaactctgaatctaggactccatgaaaagccgggtcacccacaaaacatttcttccaatacaaagtgtattattacgtctattataaactagtttcatttcagttatttatcttcatagagtgggaaagtctttttctgaaatactaattctatgaaaataataattttagtgaatctttgccaagaagttatagaaacttggaaataaatttctcattttcagcacaaaattaagtgatagtccctaagcagtaagagagaataccatgtatttacactgtggcatcatttagtatagtttacactgagccatatttatttataggcatttaaagtgaatcagtatgtgtagtgttgataaaaatcagtatctgtaaagataacatcaggaattcaaaaggaaattgaaaaggggcagaactagtgagaaccaaaaagaatgaactccagtaagactaattgaagacatacttggagaggaaaaataaacagcagaaatgcactaaaaaatactggctaattattgcaaacagagtgagcaaagattaatgctaactagtaaaagtagttagcaaagtaaacaggtagttttttaaaagtaagcacaattacaatattgaatagtatggagaaatgcttttctcctgaggattttccttaatcaaaaaataagaagaagcaataaattgtctttggcctgagtgctgagtggcataaataaaggagcttggcttaatctttctggtccacacataatccattagatcccattcatatatccaactctggattctaataaaataatttggagaactttgagaaaaaggaaaactgttaaataagaaaagacctatttagaaattatactttagtctaacgaagaggaggtacaatagtagtcttcaagaaaagaatatttaacaaatgatagatatcagctatagatattgttactaagtctagaataaaaaaggcttcagtgtgaaggatgtatagtaactctaggaaagagatttttaacactgggaaattaacgtggaaattgataatcataaagaatatttgttttgtaaaaattgaatatcattggtggtctagtaagtattaagtggcaagataggagaatgcatttcagttctgggagctcataatcctgtgattcttttattttaagttttaaaatacattaaaattttactggttaatcataaaatattttatatttgaaaataggatggcaatctttatttttccaagatatttgttggaaaaaaatgatcgttggtattattttttctttcagctatattccatggtatctttaaaattgttcagaatataggacttttactaaaaaaattcaattgtcagagtctaaaaaaacaatgtcctcaggaatacttcagaaatagaaggtatgcaatcccttagtggggggcaaacacatttcagatttcgtctttatttaaaaggatcttcagtctacaacatttgcttttttcgtgctttggaaaatatccttgtgcagataagttcttctgtttgaaacaagcatgaaacattggtccaataacctaagaatgtggagatttcttgatattctgtattaattaaagttctctacatgtctcaaatggagatcacaaaacatgaaaaggaagaaatgaaatatcttttcttctgggatgagtgtcaattttaatgtataattgtcataatcaatcagccaaaagttacaatctgtccctcagagacattgggggaagctgatggatttccagtaaggaactgtggtgggttcaaactcaggctgccacaaatacattgatatggtaggtaggaagtaggactaaatttgaaagaaacttatgggataaagttcacaattttaaaaaggttgccctccagtttttttgtttgtttataaactagagtgatttttaagtaacccttatatttaaggctgcaaaaaatgtacaagagtatgttttcaagtaaagggaacataattcttcaaaaagctgttgaactggagttatgataggttatgacagagagcatgatcagtgctgatactgacaagtacttttttaccttaaaatcaacttctatggaactacaagatcaatctagctcccgagtgacattttccattgtctgtaataatgccctcggatgagttgtgtctaaaattaagttcatctttatttatatgcgaacttaactgccatagtccctaatgtattgcgtttgtaacctgatcgtattatgtttacagctgaaagatttcatctagacatgtctttcgtccttattattcaaagtgtaattgaaagagatatttagtattaagacatgttccccaattgagaattttccagaatattctacttaagaagaagaagagcaattaactgcctttagtgtaagggcgagagtgcatagaaatatgcaatgtaaaatgtttgcatgaattatttcacatcatgtaagctttcccatattcataagatgaacactatagaagtctcatttctctgtgatcttctgtccattaggaaagtaaggagattgttatctatatctagtctcctttccatattgaactgcatggctctaatcctcagtgtatttttatcccttctcgagttatttaaaatttgccctatttaagctgaagcctggataaactgctgagccagattattcctgtgattggagtttaattgctgtagaacacttgttgagaacacattttttactttttttctttcagaattattcctcaatcattgttctctaatgaaaacaccgagaagtaaatctggtgcttcttagtgtaaatatgtttttctttttaaaaagtcattttaaaacaaagatgagagaactataaagtaaggggaaatatcattttatttaaaaataattattcaatgatagataatggagatacagaatgactcattgggttcataggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttaattgcagtttaattattatgccttttggggttaaatgatgtgaagtgtttccacctactgataaataccatatgaaaacacgactaaaagactgatttaagaaacttgttatttttaaaaatatgaatttcaaaagaaatgttctcaaagacacatgcatttattttaaattcaaaaaattcttatgaatttattattgcttgtactttaactttttttattgtagacaatcctaagtgaataatgtctcatgggagaacacatgatatgtgcttgtatttgtgtaatctgatcatgcactcaatggttggaaaaggcactccagtgctaagaaaataaccagaagccaatatatcgattcttatatctcggtttatgttaccaactgaatatggtgtaatgcataactttttccagtaaataaactggttattttttgttcatttca

SEQ ID NO: 3549 - DNA, 6427 bp, Homo sapiens
gcggcggcggctgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcgtaagtcacacctgtgcctgtgccagcgacagggccgagggcaccgggctggccaaccaggtgttctgcagcgagaagcacagcatttactgtgattaggggctgtggggcgccgcacgctgcagctaacatctgcttcacctcaactaacccagcagcagcgggacggcggtgctaggtcaatcttaacgtgactaatgcacagagggtaggagtctagccgaggcgccatggggcgttgcatcagcaggacacttgtgagagctttgtgtcgcttctcactcctcaaagccccctcaggagcacccagtcctcagctgctctcttaggtgggggtcagaggtggggatagagctgcacattcttgcagcagatgtgtgatgaaagcatcttctaagccctgcgcacccgtggggaaacccaagggaggagtcctggtcctgctccctcagcacccaaaaggggcagaacctgagttgagacttgcatgttcctcgcatgtgtctaatgtcagcactagaaagcagttttaggaggttccagcctgcagcataggtacgacctcagaggatggctttgcacttggcatagtttcatggaaaggagtacgttgtagtttatgcagtatctgactgcaaatcatattcaggaaagaagtgcagaatttcttccccaagcccagagaagagcagccctgagcccctgtattctgctggccagacacacatggcacagacacagctgaccataacccaggaatccagagctcggtttctcatttctgagatcaggatgcttgtatagtggcctgtgaggtgacagattggcagggcccaaggccccaggttttcatttttcatgagaaaagctttccaagtgcctggccagaccttggtccttagtgcagagcccgtccttttgtacttggggtgaccccagcagccaattatccggccttccatagggggttcagtcccaaagacatggggctttgaaaaccctagcctgaagtctgagccaccaagggcttggctgggttggacacccacaggtgtatccagagcccagcccggtgctgggaaagctttgcatagggccagggccacttgtcaggattcacaggtaggagatgtttaggtctctttatttagtgcaatctgggggatggcaacagagaaagaggaaaggtagctgtagggttctcccatttccagaggctccatccacacctgccttcccacattctgagcagaacttttctcagtacttttttcccgatcaccctgtgggaccagctggacctgaggctgcagtcttctctcctgcaggctgcttgccttgtctctcatgcggaagaggcattcgagttacctggtgagagaccgtgttgccccctcccacagctctctgccctgcgcgttcttccctttggtgccgagtatgtttcggtcccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcacatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcaca

SEQ ID NO: 3550 - DNA, 4636 bp, Homo sapiens
gcggcggcggctgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcaca

SEQ ID NO: 3551 - DNA, 2402 bp, Homo sapiens
cctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtg

SEQ ID NO: 3552 - DNA, 2253 bp, Homo sapiens
actgctcctcctcctcctcctccttctgcccccgggtgtccactggcactgggagagggtcctacagcggcagcaggcatcggaggccctgccctgccctggaggaagggaaacaccatccaggtccatccgccatgtggcccctgtggcgcctcgtgtctctgctggccctgagccaggccctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 3553 - DNA, 2247 bp, Homo sapiens
actgctcctcctcctcctcctccttctgcccccgggtgtccactggcactgggagagggtcctacagcggcagcaggcatcggaggccctgccctgccctggaggaagggaaacaccatccaggtccatccgccatgtggcccctgtggcgcctcgtgtctctgctggccctgagccaggccctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgc

SEQ ID NO: 3554 - DNA, 846 bp, Homo sapiens
ctgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgact

SEQ ID NO: 3555 - DNA, 3377 bp, Homo sapiens
gtcattttccctctactgctggaaaagaaggctcaagaggaagaatccaggttttgaggttttgctgaagatattcctgaagaatcatcccaggtgccacactaaaaaaatgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccgggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaatta

SEQ ID NO: 3556 - DNA, 2252 bp, Homo sapiens
ttcttttttgaggttttgaggttttgctgaagatattcctgaagaatcatcccaggtgccacactaaaaaaatgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccgggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatccca

SEQ ID NO: 3557 - DNA, 1071 bp, Homo sapiens
ggtccgcaaagccggtggcgcccggaggctgcacggagagcggtgcccgcgtcagtgaccgaaggaagagaccaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaa

SEQ ID NO: 3558 - DNA, 1159 bp, Homo sapiens
aaagccggtggcgcccggaggctgcacggagagcggtgcccgcgtcagagcctcgccctgtcaccaggctggagtacagtggcgcgatctcggctcactgcaacttccacctgctgggttcaagcaattcttctgacctcagtgaccgaaggaagagaccaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaag

SEQ ID NO: 3559 - DNA, 443 bp, Homo sapiens
ttgtgcctgtgtacgcagttcctgtagcactcggctgggcagaaatcatctttcagcactaagggaacatagttatgatctggaccttctgggagtggtcagtgcccaagaacagtgaccgaaggaagagaccaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgt

SEQ ID NO: 3560 - DNA, 854 bp, Homo sapiens
ggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagagaaaccg

SEQ ID NO: 3561 - DNA, 654 bp, Homo sapiens
aagcctccctgggcctctccaggggattcttgagccctggctgacaaagaccaggaagatctgagataccgggaagcctgtgactgcccatgggctccctgatgcttctcttcgtggaaacgacgcgaaattcctcagcttgcatcttccctgttattttaaatgaattatcatcaactgtggaaactataactcattttccagaagttacagatggggagtgtgtctttccattccactataaaaatggaacatattatgactgcatcaagtccaaggcaagacacaagtggtgctcgttaaacaagacctacgaaggatactggaagttttgcagtgcagaagattttgcaaactgtgtatttcccttctggtacagacgcttgatctactgggagtgtactgatgatggggaagcatttgggaaaaaatggtgttcactgaccaagaattttaacaaggaccgaatttggaaatactgtgaatgatggtttgcttgcatctgctggctatcagatacagacaaaacatgatcgatgcatccagcagtaataatcttcttcctgaaagccatggattcttcagcaggtcagaatggtctgatatacagtaacccccaattttcttaataaaataaaactctttttctccagc

SEQ ID NO: 3562 - DNA, 1958 bp, Homo sapiens
ccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataccttcctactgtgtatgtaggatttggggggatcttagggacctaatcgacttctttgcacactaaaaacatcagacaatgggacatactgactgaccagtctaggttgaaagataggcagccttacccagaacacaacattagcagctgggaaggtgtctgaggtccccaattacatatcccaaagagtttcttacttctgtttctgtcatttcccctctgttccagacagtcatcatttatcctctgttcttcctggactgttgctgtggtctcttctcatcttaactgtcccttccaaccaccctccacactgctgccagagcaatcttaaaaatgtaaactggccctattactcctgcttagaaccctgtagtgacttatcatggcctctgaaaaatctagactttcattatgcatacaagtcccttgtgtttttttgtttgtttatagacagggtctctattgtcacccaggctggagtgtggtggtgtgataatagctcaccttgacctcctaggctcaactgatcttcccacctcagcctcctgaatagctgggactaccagcacgctccaccatgccttgctaattattttttatacagatggagtctcactatgttgtccaggctggtcttgaactggcctcaagtgattctcttaccacagcctgccagagtgctgagattgtaggcatgaaccaccgtgcctaacataaggcccctatttaaacatttttctt

SEQ ID NO: 3563 - DNA, 2024 bp, Homo sapiens
agtgaaggacttgaaattatggcagatggagaatggagccgacttgatggaatgaaggcaagtggagggatgtcggaacaggctgctttggctggattagcaccgggtgtaggcgggacacttagtcattctcccttggcccagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataccttcctactgtgtatgtaggatttggggggatcttagggacctaatcgacttctttgcacactaaaaacatcagacaatgggacatactgactgaccagtctaggttgaaagataggcagccttacccagaacacaacattagcagctgggaaggtgtctgaggtccccaattacatatcccaaagagtttcttacttctgtttctgtcatttcccctctgttccagacagtcatcatttatcctctgttcttcctggactgttgctgtggtctcttctcatcttaactgtcccttccaaccaccctccacactgctgccagagcaatcttaaaaatgtaaactggccctattactcctgcttagaaccctgtagtgacttatcatggcctctgaaaaatctagactttcattatgcatacaagtcccttgtgtttttttgtttgtttatagacagggtctctattgtcacccaggctggagtgtggtggtgtgataatagctcaccttgacctcctaggctcaactgatcttcccacctcagcctcctgaatagctgggactaccagcacgctccaccatgccttgctaattattttttatacagatggagtctcactatgttgtccaggctggtcttgaactggcctcaagtgattctcttaccacagcctgccagagtgctgagattgtaggcatgaaccaccgtgcctaacataaggcccctatttaaacatttttctt

SEQ ID NO: 3564 - DNA, 1217 bp, Homo sapiens
ggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataccttc

SEQ ID NO: 3565 - DNA, 2024 bp, Homo sapiens; identical to SEQ ID NO: 3563

SEQ ID NO: 3566 - DNA, 2599 bp, Homo sapiens
gaaatcacagcccttcagctgccacggtgagaacgcagcactcgggttaggaagcggatctcgcaagctccgagcgtcagctgccggttcggtgccatggcgtcccagggtcgtcggcggaggcccctgcggaggccggagacggtggtgccgggggaggcgaccgagacggattccgagcgctctgcgtcctcgtcggaggaggaggagctgtacctgggtccttcgggcccgacgcgcggccgccccacggggctgcgggtggctggggaagccgcggagaccgactcggagccggagccggagccggaaccgacggccgcgccgagggacctgcctccactcgtggtgcagcgggaatcggcggaggaggcctggggcacggaggaggccccggcgcccgcccccgcgcgctcgctcctgcaacttcggctggcggagagccaggcgcggctggaccacgacgtggcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggtaggccttgctgcctctgggacctgactctgtctcctgtgtctcttatcaccccccacccccgctcccatcttggtgtcacccatgggggctaatccggtccccttggataatgctttatattggatatagttcaacccctactgcggagaccagggccccactatccttagatctggttcctctcccgatcctgaccctgccgcctggttctgagccttcccctggggcttggctccagcctttgttacatagttgctccttaatctgtttccaccctgggggctcaccaattttttttttttttttttttttttggagacagggtgtttatctgtcacccaggctagagtgcagtggcgggattactgctcactgcaacctcgacctcctgggctcaagtgatcctcccagctcagccttcaagagtagctgggactgcagacctgcaccaccacgtccagctgcccggttaatttttttctgtcggtttgaagaggggagaaggtctcactatgttgcccaggcttgtctcaaactcccgggctcaagcaatcctcccactgtggcgtcccaaagtgctggggttacaggtgtgagccaccacacactgggctctgctctgcctttctgagtttggtttctgcttatggtggggagcttgttcccgttcttcccacaagaacccaggatgtggcacagcttccctgccgtcttccttcactcagttggctacgcctcccatcctagctccacttccagaactgccttcaccctaggctgggtccttgttttgtttttagagacagggtctcactgtgtctcccaggctggagtacagtggcgtgatctcggctcactgccacctccacctcccgagttcaagcgattctcctgcctcagcctcccgagtagctaggattacaggcatgcaccaccacgcctggctactttttatatttttagtagagatgaggtttcaccttgttggccaggctggtctcgaactcctggcctcaggtgatccacccgcctcacctcctaaaatgctgggattacaggcgtgggccactgcgcctagccagctgggtccttgttctgctgcccaagcttggccctggttccgtgtgctggttctactttttgttctcccatctgcctcctgcctcctcccctttgagcttagccccgccctctcagcctgatttctgtttcccaagtccagcagtgtcgtgggataggttttgctttcttttactgtctccatcctacttacacctccctgatcctggggtctggggactccccatggtttccttccttctgcaggcccaaaatgatggcccctcttaacccaaggcaggggatcttcctcccaactccctggaccaaggtggcatttcctgcacacccctccaggccaagatgatgctcgctctcaactctgtaggccaaggtggcgtctcctcttgactctccagacctaaagtgacacccttcaggcacttcgggcccaattcagcccagtcctggtgctttcagcgccagatgacagcactttgcagataagaacgatatgatgtgtggatttcactacatttggctcctggatgctataaaaggacttggatttctgacttggctcagggactggggttagcagtctctttctgctccttttcacctgtgttttcttccgatcccagctctggtccctcagccgcattcatatttactctcctctcccagcctgatatccctgtccctcatctcaacccgaagccaagatctgagcccccaagatggagaatggggaggagctttttatggcggactgattaaaactcttaagcattt

SEQ ID NO: 3567 - DNA, 2075 bp, Homo sapiens
agcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaa

SEQ ID NO: 3568 - DNA, 2138 bp, Homo sapiens
agttggacttggggagggctgcgcaaaggctgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacatta

SEQ ID NO: 3569 - DNA, 2097 bp, Homo sapiens
attgtctccgagtcggccagctggagcgttttcggggctgtaaagggagaatggcgcatgcgcatattcagggcggaaggcgcgctaagagcagacagatttccccacgcagacgctgtgtgtcacagggggaatgggcagcgtcactttttacatccagtcatattgtatgaaattgcaacaaattcaaaaagatgccatcgtgggagtgtgaagacactattgtaatagcatggctaggaaggaaacacagctaattattaagatgaatcatttagcaagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcac

SEQ ID NO: 3570 - DNA, 1820 bp, Homo sapiens
cacttcccgggagaggtgagaatgtaaacacgcgcgttctccaatcagaactgcgctctcttctcggctcctccattcgcgcgccagaatgccagagggaggcgggactagcaggagattgctgcctatgcaaagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgcctt

SEQ ID NO: 3571 - DNA, 2156 bp, Homo sapiens
gacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcagcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatggatggagtctcactctgtcaccaggctggaatgcaatggcatgatctcagctcactgcaatctctgtctcctgggttcaagcgattgctctgcctcagcctcccaagtagctgggaccacaggcgtgcaccaccacacaggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtgg

SEQ ID NO: 3572 - DNA, 2088 bp, Homo sapiens
gacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcagcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtgg

SEQ ID NO: 3573 - DNA, 1928 bp, Homo sapiens
gcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaa

SEQ ID NO: 3574 - DNA, 2073 bp, Homo sapiens
aggatgggtcctcggccggctcgactagaagactaagggggcgtctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacattatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 3575 - DNA, 633 bp, Homo sapiens
acataaagccagagacaaggctgaacaggcggcagggccatttggtgagacagtcagctgaccccgtgtagaaagagccctgactcactggggagtgggagaggaagacaagtccgaggccgagcactgcccaccctgacgtgatggcaggggagagcccagggccacggacctggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagct

SEQ ID NO: 3576 - DNA, 566 bp, Homo sapiens
tagaccgccagtcttgtgggtccctcgcacagcgcggattttcgggcgggaagaccggaatgcggtttgatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacata

SEQ ID NO: 3577 - DNA, 685 bp, Homo sapiens
cttctgggtcaccttaggcgtcgccgggtccccgtcactggggttttccttccgcataccccgggaaggcagggcgcccctgtccggcttcaggtgattgccgtgattggacctagcctgggccttggggggtcccttcccagcccggaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctc

SEQ ID NO: 3578 - DNA, 2036 bp, Homo sapiens
atattgtcccttctgggtcaccttaggcgtcgccgggtccccgtcactggggttttccttccgcataccccgggaaggcagggcgcccctgtccggcttcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacattatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 3579 - DNA, 581 bp, Homo sapiens
ttcctgcggcgtcggtggcgagctgaggtggaggcaggctgcggcagacggcgacagtggcggcggcgccatggcagggcttgcaggggcgcgagttgggaaccctctcccacccgaaaccccgtcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctgg

SEQ ID NO: 3580 - DNA, 2205 bp, Homo sapiens
aggatgggtcctcggccggctcgactagaagactaagggggcgtctccccggcttcctgcggcgtcggtggcgagctgaggtggaggcaggctgcggcagacggcgacagtggcggcggcgccatggcagggcttgcaggggcgcgagttgggaaccctctcccacccgaaaccccgtcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacattatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttt

SEQ ID NO: 3581 - DNA, 591 bp, Homo sapiens
atctgtaggagggatacaggaaggattggcgcccttcgtatgcacggaaggaatgagctctacggagaagtggttggaatatgcttggggatagttttctgctggacaggtcgtttcgacctcagtcttccgctcccctcccccaagccctggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcaccta

SEQ ID NO: 3582 - DNA, 588 bp, Homo sapiens
ttcctgcggcgtcggtggcgagctgaggtggaggcaggctgcggcagacggcgacagtggcggcggcgccatggcagggcttgcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcgg

SEQ ID NO: 3583 - DNA, 572 bp, Homo sapiens
cttaccgcgtaggtcgctaaatgcctgggtgatcgtccgcagcggtcgcccgccgcgccccgagtctttgttccctggcaggcgcgggcgcactagggagggtcagcgcgaggaggacggcgcagggaatgggcagggggcgcgcggtgccggcagcggcacttgggcaggcaaggatcgcggcaatcggaataggacgggtccgggaagcggcaatcgcgacgcagtcttgcgggttctaggggcgcgagttgggaaccctctcccacccgaaaccccgtcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctg

SEQ ID NO: 3584 - DNA, 2417 bp, Homo sapiens
gacggcgctgactcagcaacgcgaggggggagttttgtccctccgcggaccccgtttctcccagcctcagcctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgag

SEQ ID NO: 3585 - DNA, 1473 bp, Homo sapiens
accgttaccccgccgggcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatcttatacaacagaggcaaccagaaggatgaatgatattctgaatcacaagatgagagaattctgtatacgactgcggaacctggtacacagtggagcaaccaaaggagaaatctcggccacacaggacgtcatgatggaggagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggctgtgtggtttggctgtgatgttggaaaacacttcaatagcaagctgggcctcagtgacatgaatctctatgaccatgagttagtgtttggtgtctccttgaagaacatgaataaagcggagaggctgacttttggtgagtcacttatgacccacgccatgaccttcactgctgtctcagagaaggatgatcaggatggtgctttcacaaaatggagagtggagaattcatggggtgaagaccatggccacaaaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaagg

SEQ ID NO: 3586 - DNA, 2336 bp, Homo sapiens
gtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgctgc

SEQ ID NO: 3587 - DNA, 5567 bp, Homo sapiens
gtcgcgatgcctattttagtcaaagcggctgcgggcttggggacccggcccgggcagcggagcttccggacccgccgacccgccgaggagcgcgcgtcgggctcccgtcgagcagctgagcccgtgtgccccgcgtcccgcgccccgaagctgccgctccgaactttggtcggcgctgcccaggctccccgccagggaccagccgggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtggagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatatatacacacacacacacacacacacacacacacatacatacatacatatatatatatatatacatatatatacatacacacatacatataattttttttttttttgagatggagtttcactctgtcgcccaggctggagtgtagtggcacattctcagctcactgcaaactccacctcctggattcacgccactctcctgcctcagcctcccgagtagctgggactacaggcacctgccaccgcgcccagctaatttttttgtatttttagtagagatggggtttcactgtgttagccaggatggtctcgatctcctgacctcgtgatccgcccaccttggcctcccagagtgctgggattacaggcgtgagccaccgcgcccggcctattccatatttttttaatgggacattttagagaaaggtgtgatttgactggttttatttttctcccaggccagaagtattactccactagatcaccttacttaattgggcactgtgtggataacttgataatgaacaaaactctcagattttactcacattacccttgtattatgccatttataaactgctctgaaacctgaagctggaaagataacagatgggtttctgagcacggggttaacctccagctaaactcaacttccttgggatttggagtcaccatgttgtgcacactctggtgtgggaaacactttatgtagggtgggaggacaggggagttaaatggctgggcaggtgccacaggatgaggccactgaaagatctgcttcattctttgatctgtattctgaagttccagattgttcatctagaggcagagacatctcttttaaaaaagtgccagatgccccagtgccagagctgcgaacgtgaacacagtggaaggcagagggtttactacaggccaggccatggacaccccacccaggtactgcagtgagggccttgattccagagctctttttcctactgaaatcatggtttagtaaacagtggcatttggctggtgggaaatgcgtaactggtcagtgtgtctggccagcgtggctgtggcacttggccaggacgctccgttgaatgaagctcattgattggccatgctggtcatgtctattttgcttcatccactagaaccaactttgagtcagtctcctgttacgttaaatggctaagaaaagttccaaatgaagttgttctcaggtgaactgagccaaaagaagcaactcttaccatgaggtgatttctgttagaggagacatataaataagctcatctagggtcacctcattttcctaaatatgtttttaaagcaattattgtagtaatttcatttgagttaaatttacatgctcggtcactcattgagaaaatttacacagactctgaatccagttcctgtcatcttcagatgttggtttattgacatcacagtaaaaaggctactgtcgactggacacagtggctcacacatgtaatcacagcactttggggggccaaggtgggtggattgcttaagcccaggagttcaagaccagcctgggcaacatggctaaaccccatctctacaaaaaaaattagctgggtgtggtggtacatacctgtagtcccagctactcagaaggctgaggtgggaggttcacttgaacctgggaggttgaggttgcagtgagcacagatcacaccactgcactccagcctgggcaacagagtgagaccctatttcaaaaaaaggctgctttcactgtactgctgcagcagtctcttcaggtagctaaattaggagcttgttttggagaaatgaagcaaaggtgaatgacagcctaggcttgaaattataaagctctctcaggttgaactctctcgtgcgctctcgctctcactttcgccctgtacctgagagcacaggtgtaactgtgatgtcatagtgccgagactactttcctttaaccattggggttaagttgggcagcccatttagtttacacgcgcataagactaatttacaaaatcactctatacagtcattagatgtaacatccttccctgagtagaaagtaatgcatgtgtttggagattattttctgtaatgctgggaacaaacctgttttaaaagcacactgctaaaagtaggtgatataagaccatttgctgtttttattaaagtatgtgtgtgtatcagtgtctcaatgtgaagattgtaacctcaagattaggaatcttaaaagagccacttagcctgaatgggaaacgtgagactatttttaaacacacacctctaaggaagaagcctcccatatagacttgatctcaaagaagcagataagaagacagaaaagtgttttaagtgtaagatctcctatggagtactttaaattcatttatacaaatgaataagtgtatctttgtataatgcataaatacatagataaaaacatgtttgctgccaaagttcccaataagatgcttcctgtgttttttggcctttacttagctgaatgatcaaagttcagaaaatggtctgcaaaagttactccatatacaaccccaaatctactactttaaatgtaacatcaactcagttgtatgaatctggagtgtaatatttatattagaatgtatatgtcatttaaaatattttgaaagccctcataaatatttatatttactaaactaatagcatagacactatataaatccgcagtgatgcttatatatcttaaattagtaataatgggtgctatataattattttcagttactatccctgacactctggaatcttctccatttctccctatcactcaatttcattttaatcattggacacctttgcgttttgctgctaacagtgtgtgtatgtcaccctctttatatctggttttcccacttgtctgaagctctcctgatcttagaacctggagctgcagattcctccatgtcagctcccatcacggccccaaagacagagtcacttggttgctgagtcacttggttgctggaaaaatctttggggaaagctggtataagctacacactgacctgtccccagtgtttccaggtaatgacttggcactccagagaaagtttcatgctgttgcgtgtggtggctccaagccaagcacctggcatgcaggtcagcccttcccagcgggcgtggcgtcgtcctcttcacagatgccacgttgcagccccaaggcctcaccattttgcgttttttagaaacccattttcttggtcatttataaagctgctttatagatatctttgatcctggcatgccttggtttcctctcccttccctctttccaatcctggtttcctaacctcctcttgtagtaattctcaactcaactcaaagtcccaagaatttggaatggtaggatgctgtgcggggagctcgaggctgaggcataatcactgcttcggttctgctcatcaggggacacgctcccttactcatggcagccatgtttgattgtcacagagccccccgaatactctgtctatagtgacacactgtaggtgtcataaattttaagaaacctgcttttaagtactatttataggtttttctgttatacttgcaacctagttttaaaatacatgaggattttatgaaagctttatacagacatttataggaaactcattctttgattttaggtgccatttaaattgataacacttactttataaaaagatgctttttgtctggatagagccttatagtttaaaatatcttcatatattgccatttgatcaaataaatttcttacttagaaaa

SEQ ID NO: 3588 - DNA, 1663 bp, Homo sapiens
gcggccgccgctcaggtcaggcagccccagcgtccccgggccctcggccccaccgagtgccggctcccgcgctctgcggcggcaagccccttggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtggagtcggagggaggaagtgaggaagggtcaaggatggaagagttctttcacttaccctttttattagtcagcttttaaagtaattgttttactgagccttctgactatgccttgttctcttttgagatatatattttcacagtcttttctagatatattattgttttaacttaacaaatcttagcaatctctcaatgccttttcacttatttttttccaagttatgattctttttcctcacagtcttttttgttccatagcaatgaggttgtccatttgataattttaacaaacaatgtaagtttaaaattgaggctaaggtaacatgaaaaagcagggaatctcaaactttattccatata

SEQ ID NO: 3589 - DNA, 1500 bp, Homo sapiens
ggagagcgccgatggctggggacccgaggtccgcgccacccacccgcaacctccttccccgagcctttgggaacgggttgttggccagacaagtcccagaaactgcctgctttgaagcatgaataagtgcgaaaagactcttagcaatgaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggatgtaccctttatatcgtctgggccactctctaccgatgtgccttggatataatgatctggaactctgtgttcttgggtgtcaacattttgcatctgtcgtatcttttatacaagaagagaccggtaaagattgaaaaggaactcagtggcatgtaccggcgattgtttgaaccactccgtgtgcctccagatttgttcagaagactaactggacagttttgcatgatccaaaccttgaaaaagggccaaacttatgctgcagaggataaaacctcagttgatgaccgtctgagtattctcttgaagggaaaaatgaaggtctcctatcgaggacattttctgcataacatttacccctgtgcctttatagattctcctgaatttagatcaactcagatgcacaaaggtgaaaaattccaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaaaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcatgtgtcatccccacaccagcgagcctctgccaagatgaaaccgatagaagaaggagcagaagatgatgatgacgtttttgaaccggcatctccaaatacattgaaagtccatcagctgccttgatcagagagagaattcaggttaccaagacggaaggtgtcttgaagagatcctgaaaaataccagcactttttcatggcttttaggttattctgctttagtgcatccagactggtggagtcggagggaggaagtgaggaagggtcaaggatggaagagttctttcacttaccctttttattagtcagcttttaaagtaattgttttactgagccttctgactatgccttgttctcttttgagatatatattttcacagtc

SEQ ID NO: 3590 - DNA, 1877 bp, Homo sapiens
cgccgctcggagccgccgggcaggtcccccagcgctcgcgtctgggcccgccccccgctgcggggcggattgacaggagcccggcggccaatcggacgccgtggggcggggcgaggcggggcggtgcaggccggctcccggcgcggggcgctatttacggcgcggagccggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctgaaatttaatagtgtctttcataaatttaactgggaaacgtgagacagtacatgttaattatacaaatggccatttgctgttaataatttgttctcaactctaggatgtggcttggtttttttttttctcttttcttttttaaacaagaccaagatcttgcttattcttccatg

SEQ ID NO: 3591 - DNA, 1484 bp, Homo sapiens
gctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccacacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctg

SEQ ID NO: 3592 - DNA, 5031 bp, Homo sapiens
ggacagtggagacgcgccttctcggctctggtccgcgccctggggccctggcctccctggaggggctggggaactggaagctgggccgagagagttcccgctgcagctatcgcgcagtccctcctgcgcccgggcgcccccagcgggttccgggaggcgcccggtgagcccacgtctgttgcggcggagcgagcgcgctccgggagggccgagagccggcggggctggcaggagctctcgggcgcccgcctccctccttcgcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaaggttgcacctatgaaggaaatacctataacagctccttcaaatggcagagcccggctgagccttgtgttctacgccagtgccaggagggcgttgtcacagagtctggggtgcgctgtgttgttcattgtaaaaaccctttggagcatctgggaatgtgctgccccacatgtccaggctgtgtgtttgagggtgtgcagtatcaagaaggggaggaatttcagccagaaggaagcaaatgtaccaagtgttcctgcactggaggcaggacacaatgtgtgagagaagtctgtcccattctctcctgtccccagcaccttagtcacatacccccaggacagtgctgccccaaatgtttgggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctgtgaccaaggccaggagggctgttgtgaagagtgcctcctacgagtgcccccagaagacatcaaagtatgcaaatttggcaacaagattttccaggatggagagatgtggtcctctatcaattgtaccatctgtgcttgtgtgaaaggcaggacggagtgtcgcaataagcagtgcattcccatcagtagctgcccacagggcaaaattctcaacagaaaaggatgctgtcctatttgcactgaaaagcccggcgtttgcacggtgtttggagatccccactacaacacttttgacggtcggacatttaactttcaggggacgtgtcagtacgttttgacaaaagactgctcctcccctgcctcgcccttccaggtgctggtgaagaacgacgcccgccggacacgctccttctcgtggaccaagtcggtggagctggtgctgggcgagagcagggtcagcctgcagcagcacctcaccgtgcgctggaacggctcgcgcatcgcgctcccctgccgcgcgccacacttccacatcgacctggatggctacctcttgaaagtgaccaccaaagcaggtttggaaatatcttgggatggagacagttttgtagaagtcatggctgcgccgcatctcaagggcaagctctgtggtctttgtggcaactacaatggacataaacgtgatgacttaattggtggagatggaaacttcaagtttgatgtggatgactttgctgaatcttggagggtggagtccaatgagttctgcaacagacctcagagaaagccagtgcctgaactgtgtcaagggacagtcaaggtaaagctccgggcccatcgagaatgccaaaagctcaaatcctgggagtttcagacctgccactcgactgtggactacgccactttctaccggtcctgtgtgacagacatgtgtgaatgtccagtccataaaaactgttattgcgagtcatttttggcatatacccgggcctgccagagagagggcatcaaagtccactgggagcctcagcagaattgtgcagccacccagtgtaagcatggtgctgtgtacgatacctgtggtccgggatgtatcaagacgtgtgacaactggaatgaaattggtccatgcaacaagccgtgcgttgctgggtgccactgtccagcaaacttggtccttcacaagggaaggtgcatcaagccagtcctttgtccccagcggtgacctttgtttcgatccttaagactctgaaatctggtgactttgacactgaagcggaagagccaatgaaggactgcagtatttgtgtgcccgattctgtaaacacacacacacagagtatatatgtgtatatatatatagatatattcaaaaacattgcatcatttatatgaactatagggggattattatatgtatattttttgctataagacatgtattgtttctaggatcctaacctgtaagccattgaacatgttgtataaatacaccaggtgtttttaatttaataaggtggcatgcagatacattggatagtgttaacatcacatacatttgtcatttttaaggaagttttctaagagccctcaattgcctgcctgtattaattttagttttgagtcaggatttgtaatggagtgggaaatgtgtttctctggagaagggcacatttatctaggggcatttcaggtttccaaagaaaggaatgtatgcctgggaaagacagcaggagattggtgaccggccctaatggtgcatgaaaagcgagtgataggctgttagaatgtattaggtcatgggctaacattatttccaaaattgattggctggttgccaagaaatatatatttgtcactagggcataaccgaagaatcaagtgatttcttgccatccttgcgtagtcctcaagtcttctaatcatctatgtgtgtatgatggatgtgaccatttatatgtcatgtgttgaaattaaagggtgtctggatgccatgttaattttattgagcatgagaaagtatttgaagaaactgttgcacaacatatgatgaaattttgatttctctgaatctcagagtaatttaagatgggcaaatccaatgagttgatgtaacccatctacattttgtggctatttcatgtataaaatgaaaggctttagttatttctagaggagtcccatccaacactatttggcgactgttaatatgttataattattagacagtggaaaagcctttattgactaattgatttaacctcagtccaaagaacagtctctatacttgccctcatttactgataggctgctactagttaccatttgattgtcttgactttcgtcttcagttgaattggtgaaaacatcaacaaaaacaaaacccactgtgtcttaaaataaaatgttctgcattgtagtcaataaagggcttaagatgtaaaacaatgcattttctctctcaagatgtcctgtgttatactttacaattagttgtatcaacttcagattcattaaattttaacagctgtatttagttataatttttgtatcttacaacagtatatataaagactattattaatagacaaaagcaaacccacgtttttgacaagccagcatattgccaatgctcgtcaaagacatttatgtttcttttacattcatgacagctaaagtattaacttggaatttttttttttttttttgactggaaaatccctagttgtttgaattaactgaataaagtgcagggcgtaatagtgactggctgggggcactgggcctttgtgttttttttcattcctgtgtttggatactaatcaccctcgtatctgcagcctgaggtagtcaggtcattgtttcaatgctgcccttggaaagaagactttgacttaggtgctttgggatctaagtgtggtttgtgactatccccattatttaagcatttgggggtctcacttttgcttatctgtaacacaaagaggccatgtagtatagtgagcagggttgagaatcgggaaaactagacccctgccactaacaggctaggagactttgggcagtaatgggaggcactgagggtttgcaaatactttcctacttgtaatctcattgattccctgctctgccctgacaggaggggtagggaaaatcagttgacgttgcctggtggttcctaccttctgtaaaacgaacagattccttaagattagctttaaatcccttttcagttcactgttggttctcatctttgaaagagggcagcataagggaaatgatggagaagggagaattgtggatggttatttatagctcatgattcatccaaggactgagttattctccccatgaggctaaccggcctctttcccaacacttaatcatggcagccaggatgggtgaatgatgaaagctcttctgcatgagccggtttcatcatcttgggtgggttgattacaagtttgtgtggcattcctttagctggggattagcttaatctctgtacatttttctcatttctaattgaagaagaaagggagggcagagaggacagaaaattacttgggtttactaattcaaagagccatctctgatgggagagggtgaggaaatcagctgaatggttggcctgcatattcttttttaggccacaggctacagctgagcaatggcttagtctaatgattgggcacaatgaggatttaccaagtgcttcaatgagagcagtcctgtttcattcacatgggatgttttcaattggttcttcaactaagctcttgcagagtgagatgacttgaaataaaaatgttctatgaatattg

SEQ ID NO: 3593 - DNA, 3399 bp, Homo sapiens
gcggacggtctcccgacacgccggctgagagcccttttcgactgtgagctgcggcagctgagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcgggggtccccatgtctctggcttcctccttcttgacaggttctgttgcaaaatgtgaaaatgaaggtgaagtcctccagattccatttatcacagacaacccttgcataatgtgtgtctgcttgaacaaggaagtgacatgtaagagagagaagtgccccgtgctgtcccgagactgtgccctggccatcaagcagaggggagcctgttgtgaacagtgcaaaggttgcacctatgaaggaaatacctataacagctccttcaaatggcagagcccggctgagccttgtgttctacgccagtgccaggagggcgttgtcacagagtctggggtgcgctgtgttgttcattgtaaaaaccctttggagcatctgggaatgtgctgccccacatgtccaggctgtgtgtttgagggtgtgcagtatcaagaaggggaggaatttcagccagaaggaagcaaatgtaccaagtgttcctgcactggaggcaggacacaatgtgtgagagaagtctgtcccattctctcctgtccccagcaccttagtcacatacccccaggacagtgctgccccaaatgtttgggtcagaggaaagtgtttgacctcccttttgggagctgcctctttcgaagtgatgtttatgacaatggatcctcatttctgtacgataactgcacagcttgtacctgcagggactctactgtggtttgcaagaggaagtgctcccaccctggtggctgtgaccaaggccaggagggctgttgtgaagagtgcctcctacgagtgcccccagaagacatcaaagtatgcaaatttggcaacaagattttccaggatggagagatgtggtcctctatcaattgtaccatctgtgcttgtgtgaaaggcaggacggagtgtcgcaataagcagtgcattcccatcagtagctgcccacagggcaaaattctcaacagaaaaggatgctgtcctatttgcactgaaaagcccggcgtttgcacggtgtttggagatccccactacaacacttttgacggtcggacatttaactttcaggggacgtgtcagtacgttttgacaaaagactgctcctcccctgcctcgcccttccaggtgctggtgaagaacgacgcccgccggacacgctccttctcgtggaccaagtcggtggagctggtgctgggcgagagcagggtcagcctgcagcagcacctcaccgtgcgctggaacggctcgcgcatcgcgctcccctgccgcgcgccacacttccacatcgacctggatggctacctcttgaaagtgaccaccaaagcaggtttggaaatatcttgggatggagacagttttgtagaagtcatggctgcgccgcatctcaagggcaagctctgtggtctttgtggcaactacaatggacataaacgtgatgacttaattggtggagatggaaacttcaagtttgatgtggatgactttgctgaatcttggagggtggagtccaatgagttctgcaacagacctcagagaaagccagtgcctgaactgtgtcaagggacagtcaaggtaaagctccgggcccatcgagaatgccaaaagctcaaatcctgggagtttcagacctgccactcgactgtggactacgccactttctaccggtcctgtgtgacagacatgtgtgaatgtccagtccataaaaactgttattgcgagtcatttttggcatatacccgggcctgccagagagagggcatcaaagtccactgggagcctcagcagaattgtgcagccacccagtgtaagcatggtgctgtgtacgatacctgtggtccgggatgtatcaagacgtgtgacaactggaatgaaattggtccatgcaacaagccgtgcgttgctgggtgccactgtccagcaaacttggtccttcacaagggaaggtgcatcaagccagtcctttgtccccagcggtgacctttgtttcgatccttaagactctgaaatctggtgactttgacactgaagcggaagagccaatgaaggactgcagtatttgtgtgcccgattctgtaaacacacacacacagagtatatatgtgtatatatatatagatatattcaaaaacattgcatcatttatatgaactatagggggattattatatgtatattttttgctataagacatgtattgtttctaggatcctaacctgtaagccattgaacatgttgtataaatacaccaggtgtttttaatttaataaggtggcatgcagatacattggatagtgttaacatcacatacatttgtcatttttaaggaagttttctaagagccctcaattgcctgcctgtattaattttagttttgagtcaggatttgtaatggagtgggaaatgtgtttctctggagaagggcacatttatctaggggcatttcaggtttccaaagaaaggaatgtatgcctgggaaagacagcaggagattggtgaccggccctaatggtgcatgaaaagcgagtgataggctgttagaatgtattaggtcatgggctaacattatttccaaaattgattggctggttgccaagaaatatatatttgtcactagggcataaccgaagaatcaagtgatttcttgccatccttgcgtagtcctcaagtcttctaatcatctatgtgtgtatgatggatgtgaccatttatatgtcatgtgttgaaattaaagggtgtctggatgccatgttaattttattgagcatgagaaagtatttgaagaaactgttgcacaacatatgatgaaattttgatttctctgaatctcagagtaatttaagatgggcaaatccaatgagttgatgtaacccatctacattttgtggctatttcatgtataaaatgaaaggctttagttatttctagaggagtcccatccaacactatttggcgactgttaatatgttataattattagacagtggaaaagcctttattgactaattgatttaacctcagtccaaagaacagtctctatacttgccctcatttactgataggctgctactagttaccatttgattgtcttgactttcgtcttcagttgaattggtgaaaacatcaacaaaaacaaaacccactgtgtcttaaaataaaatgttctgcattgtagtcaataaagggcttaagatgtaaaacaatgca

SEQ ID NO: 3594 - DNA, 2499 bp, Homo sapiens
gtgatggtgcctcaaagcagtaactttttgcttagagcttgagagtcaaagttaaggacccacatgtatacttcggctctagcgagtctaaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagta

SEQ ID NO: 3595 - DNA, 2531 bp, Homo sapiens
aggaaaatgtgaaacaatttgcttctggaaacaggacagccggggccgtgttcctgcaacagcagaccaagcaccgcggcggacccaggcaagcacggaacaagctgagacggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 3596 - DNA, 2598 bp, Homo sapiens
atgaacatacatcacaatgtgaacagtggtcatctccagatagtagaatttcagatatgtttctttccatttttctgacagtttgaattttctgtaataattaattgacttttatacaatggaaacaacttttttgttttggaaaaaagaaagatgctgccgctaatcagtggatgaaagatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatgaaaaggggcagcagaaaaggatccattgaaattaagaaaatcagatgtgtggagaaagtaaatctcgaggagcagacgcctgtagagagacagtacccatttcagattgtctataaagatgggcttctctatgtctatgcatcaaatgaagagagccgaagtcagtggttgaaagcattacaaaaagagataaggggtaacccccacctgctggtcaagtaccatagtgggttcttcgtggacgggaagttcctgtgttgccagcagagctgtaaagcagccccaggatgtaccctctgggaagcatatgctaatctgcatactgcagtcaatgaagagaaacacagagttcccaccttcccagacagagtgctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaagtagcagcagcagtgaagatgttgcaagcagtaaccaaaaagaaagaaatgtgaatcacaccacctcaaagatttcatgggaattccctgagtcaagttcatctgaagaagaggaaaacctggatgattatgactggtttgctggtaacatctccagatcacaatctgaacagttactcagacaaaagggaaaagaaggagcatttatggttagaaattcgagccaagtgggaatgtacacagtgtccttatttagtaaggctgtgaatgataaaaaaggaactgtcaaacattaccacgtgcatacaaatgctgagaacaaattatacctggcagaaaactactgttttgattccattccaaagcttattcattatcatcaacacaattcagcaggcatgatcacacggctccgccaccctgtgtcaacaaaggccaacaaggtccccgactctgtgtccctgggaaatggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggctgctcgtaactgcttggtggacagagatctctgtgtgaaagtatctgactttggaatgacaaggtatgttcttgatgaccagtatgtcagttcagtcggaacaaagtttccagtcaagtggtcagctccagaggtgtttcattacttcaaatacagcagcaagtcagacgtatgggcatttgggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 3597 - DNA, 1372 bp, Homo sapiens
agacgccccggctcggagtcccagggccacagccgaaactcgccctcccgcgcccctctccggcttgcagcgcccgcccgcaccgccacctgccacccgaggcgacgcagtccgcttctccccacccgccaggtggcaggttcagggccggggtccgagcctgcttccctgcagctgccacagccaccctcgccgccagggggcgagagtcccaggcaggacaagcagcgctgctgccttggcgtgaaggtggtttcaaactttaggcttcttttccctaccccgcgtctctgaagagcagagaggaagatggaaaccgagtccgggccgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaat

SEQ ID NO: 3598 - DNA, 3135 bp, Homo sapiens
acaccagtcttcggaagtcgcccgtcaaccggcttcttctacctcagtaaagccttaaggtcacctcaacctctcgaaacccaccagtcccagaggccgactcttctcaagtggaggagaggggaaggcgtgcatggagctttgcctgaccgctcgctctctcctccccagccgtctgagagaaggcgagaggggtcccagaaccgagccctcgctccgcacgccccacgcccgccccgctgtgccgtgcgctctgcccctgagacgccccggctcggagtcccagggccacagccgaaactcgccctcccgcgcccctctccggcttgcagcgcccgcccgcaccgccacctgccacccgaggcgacgcagtccgcttctccccacccgccaggtggcaggttcagggccggggtccgagcctgcttccctgcagctgccacagccaccctcgccgccagggggcgagagtcccaggcaggacaagcagcgctgctgccttggcgtgaaggtggtttcaaactttaggcttcttttccctaccccgcgtctctgaagagcagagaggaagatggaaaccgagtccgggccgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggtttttaatctctaaaatttctacagtagtacaggaaatattcctctttacattcatttgcagttctttcactgacctcctaattttaggtggagggggcagggggagccataaaagttggtattaccctaataaatctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaggaatttt

SEQ ID NO: 3599 - DNA, 2838 bp, Homo sapiens
aatcagggagcgccgcgcgagggtggggaccagctgcgcacgaggccagcggcggggtcgctgccgttgaggcttcccgccactgctgctggcggatttgtggggcaaaatttctcgctggctagccttcttttccctcccgcactttggtggggagggggtggatcctcgtttcggtgcccaagttcacgatgacccgagagaactcgaggaagttgtcgccgcggccatttcccccagtgccgcaacttgctggccttggagggggaggagcgccgaggcagtgactgcgacgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattccagctcaactgatttcttgtccaatgatccttgcgtggccgagatccagcttcaacgaaccagctagaagctgcccgttgtgaaacttagtgttagttaatacctcaccatactcagttattccactataagctgtctaaatttgatgaaatttgctttttcagctgttctacaaaattatttaggtagatgtggcatgttggttttttatgtgctaacctaactgtaatgaccttttctacaacatgttttatccattccataaataataaccacattgggaatagtgaggtgtcttttattttctctgctttgtgttattttttcttatcaaacaattagatgttatgtttcatattatttgatatttattttcatatttaggataagaatcatttttaattataatacttttaatactttcatatattttacaacagtatactatttaatattaatgacaattctatttttgctttgctgttttgtcatttaatatgcttttgtctaatttttaattcatttattactgttactccttatttaattttgcgtctgccatggttttcagaatctgaatagtatttatacttcttttttataacattttccaaatattagaaataccatcaacatgatcagtattcttgccttttcatgtaatttgactatattaaattttttctccagtgtttgagacaatattgaaatcttcctataacataatttatttggtatcaaattttataaaatatggatccacctttggaattttgataaaagggttcatctctgacatgatcccataacactgactgaaattccaccaaattactgttctttgaatgctttaatccttaaaccttttcttctgatatgcaaccaatatattcaattatatatgtgattaatttttaaaaggacaattgttttcataaaatgcaaaactattttttacaccaaaggaaaattttagattctgattctaaatccgatttttactataaaattggaaaatagatgggaggggtgtcattcattgttcaaaaggtacagaacaaatcataggggtttttaatctctaaaatttctacagtagtacaggaaatattcctctttacattcatttgcagttctttcactgacctcctaattttaggtggagggggcagggggagccataaaagttggtattaccctaataaatctatctctttcctcccctgtttcaaccccacatgtattccatgctcagcagcagcagcagaaatagtaggatatagatcacaaaggtttttctggtgagtcaaatagggtgttttcttttgaaactgtaatgaatatgtttgccagtcaaatggcttcatgagaacagtagaaccttatgaatgtatactagcatacaaggatctcaaatacattaattattctcagttttaggaatgtaaatagattaagtcccacaatgaaatttcagaagtttttgttctgtaagtaaaaaattactaaccactgatgttcaagattttcttttaatagcactatccttgagaaccaaaaagtttatgttttgattttcaaatgttaaacaagatgctaaacaaatcctggactgttaataaaaattaattatgtattattggataaggaatttt

SEQ ID NO: 3600 - DNA, 1270 bp, Homo sapiens
agatctcgaggttgattctcaaggggaggggccagtgagggcacattgctttggaggagtagtttaataaactctctagtgctggaagttttagcaaacggaggagccttcaaacccggcaacagtccccatctaggtgtttccgtaacacatgcggaattattgctagtggaatttcaggctttctttgttgtttaactcaatgcatcgctaattgtttataatgaacttagatgttgcctccacctgagccttgctattgctaacattaaaatattttgtaggcctggcgcgatggctcccgcctgtaatcccagcactttgggaggccaaggtgggcggatcacgaggtcaggagatcgagaccatcctggccaaaatgcaaacatcaaaccagatgcaaacagattcattatctccatcccctaatcctgtgtcacctgtgcctttgaataacccaacaagtgccccaagatatggaacagtgatccctaatcgcatctttgtaggaggaattgattttaagacaaacgaaagtgatttaagaaaatttttttcccagtatgggtctgtgaaagaagtgaagattgtaaatgacagagctggagtatccaaagggtatggtttcgtcacttttgaaacacaagaagatgcacaaaaaattttacaagaggctgaaaaacttaattataaggataagaagctgaacattggtccagcaataagaaaacaacaagtagggatccctcgttctagtataatgccagcagctggaacaatgtatctaacaacttcaactggatatccttatacttaccataatggtgttgcttattttcatactccagaggtaacttcggtcccaccgccttggccttcacgttctgtatgtagctcccctgtgatggtagctcagcccatttatcagcaacctgcatatcactaccaggccaccacacagtatttaccaggacagtggcagtggagtgttcctcagccttctgcctcttctgctccattcttatacctgcaaccttctgaggttatttatcaaccagtggaaattgcacaggatggtggatgtgttcctcctccactgtctctgatggaaacttcagttccagagccttattctgatcatggagttcaagcaacatatcaccaggtttatgctccaagtgccatcactatgcctgcgcctgtgatgcagcctgagccaattaaaacagtgtggagcattcattattaagacaattgggcagctctattc

SEQ ID NO: 3601 - DNA, 811 bp, Homo sapiens
agtcctggccctgagcgggaatcgcagtggccgaggctgagcggcaggtagaaggggcgtctccggggcttcacagggaacacaggggcttcggcccaaccacaactggaggtcgaattcaccacgtcacgtagagaaaaggggcggtgtctcgggtctccccgtgtggcatcaaggcgggctccctataggagctggtgtggacgtccgggcgtggggttagggcggatgcggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacag

SEQ ID NO: 3602 - DNA, 859 bp, Homo sapiens
aggactgcattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacacta

SEQ ID NO: 3603 - DNA, 1137 bp, Homo sapiens
ggttctgagcgttgtctgtgtttaaccttgatttcagccttgcctccctgctttccgcgtcctgacattacggctaaaattgcagttacagcttcttttacaaggagaagaatgtggaaagaataaccaatttgatgtaatttataagagctaccgggaggggtgaagggaagtcgtttgattggctaaaagcggagccgtatctaacagccaatagaaaagcagaaagccgcctcttggtttgcgtcctgcactgaaaggaaatgacggattttactttctgaccaccttaccagtggggagaatccgagactacagttcccatgagccctcagggcaccacgtggtgcctgcccgtgctaccaacgcgcagcgaggactccatttcccagcgtgcctcaggaagggcgccaggactgcattttgctccggagcgtccagagtcctggccctgagcgggaatcgcagtggccgaggctgagcggcagctggaggtcgaattcaccacgtcacgtagagaaaaggggcggtgtctcgggtctccccgtgtggcatcaaggcgggctccctataggagctggtgtggacgtccgggcgtggggttagggcggatgcggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggagga

SEQ ID NO: 3604 - DNA, 1012 bp, Homo sapiens
cttcctcccggcacagaaggcctccccctctcaccagggccctcgcccgctggtccgccaggccccgccttttttgcggcccccattgtgctgctggacccgacgagcagtgttgacagtgaaccccacgtagacgcggccccggtaccgggggttcaggcagtagagcaggtagacgccgaaaaagcgccctggcctcgccgcgacccccgcgggacccatcgggccttggggttcgggaaccacagcagggggttgattgccgtgacctagggtccaggggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacagccattaaattataaatctgga

SEQ ID NO: 3605 - DNA, 444 bp, Homo sapiens
gacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaa

SEQ ID NO: 3606 - DNA, 639 bp, Homo sapiens
ggaggctgacggcctccgggcggcagggggcggcctctcccacggcggcggctctcggtcccccgctccgcgtctttcgggcatacagtgacctcgggcggcgggtcacgtcggccgggcatggctgcatggagcccggccgcggcagcgcctctcctccgcgggatccgcgggcttccacttcaccatcggatgtttgccactcagactgagggggagctcagagtgacccaaattctcaaagaaaagtttccacgagctacagctataaaagtcactgacatttcaggaggttgtggggcgatgtatgaaattaaaattgaatcagaagaatttaaggagaagagaactgtccagcagcaccagatggttaatcaggcactaaaagaagaaatcaaagagatgcatggattgcggatatttacctctgtccccaaacgctgaccacgccctggctgcatagatgctgctgcttaagaccttggatgaacttcactgacatcattcttccctaagcagtcaccaaaaaatttatatattttgctcatatacatttccatattataattatagaagatgtataatctatttagatgttaattaaaggaaacaaacaactgaagcttttgaagggtcatt

SEQ ID NO: 3607 - DNA, 2833 bp, Homo sapiens
ctccacctcctactcttcagtgccagatgggtaagcatttagccaagcatgctgggagacacacagaactgaagcaaaggagtatctggatgtcttggattttcttcccattctgttctgttctgttctcctaataccatctcgttactagacgtaggcattggacgtgacaatcaactgcatttgaactgagaagaagaaatattaaagacacagtcttcagaagaaatggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacagatacaaggcagttgtgaagccacttgagcgacagccctccaatgccatcctgaagacttgtgtaaaagctggctgcgtctggatcgtgtctatgatatttgctctacctgaggctatattttcaaatgtatacacttttcgagatcccaataaaaatatgacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcagattgaatcccgaaagagaattgccagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctagcttttcaaggaaaaatgctgcttctcctcccagcgtgtgtatccgactctaagctgtgtgcaggtgtatggtgtccagatttttgttgtttgaaaagtgtgttgaaatcttaggagtgaaggatccctataagtaagtaaaatacaaaccattactttcttcaaagtacaaatagtaatgtcatcgggctttctaaataaaatgaagccccactaagtgcagaaagacaagtttatatatgccagtgaatcgtaagggaagtcaaatgggaaggaaggtgtaataaacaagatgaaacttaaaaatctcatttgttgtttaatcacatctgtgatgcttctaactcctcatatactgtgatttgcataaaattgtgtttgtgtttactgtgtggtgtaaatctagagatactttgtatgtgaaaaggggatcacaaaagagagaaagcatctcttaggctattttcttaaaaataaaccttcacagaatggctgtccttttccattaatctgtattccattgtagctgaatctgtgcagttgaaatgaaaatgttttggagtcagcgaatataaagcactgagtaaggatctggggcacagtgcttgccttactgggtcaacacttacaactgccatggattaataactgggctaagttatcattcacaaatattgttaggaacttgccttattcataggcagaataagtggtcatgtttatggtgtcatttgaggacctctgttgaaaaatctgcaaacctgccacagtgtctgaaattcttcctttacagaaattcgtttctttctggtaagcagtgccctctttctaaaaacatgcagaagtaccatatgaaatccctaacccctgggtgtgcaattgtgatcagatcatcttcctgcttgactttattaaacccaatgggtgcctaagtcctgtaagtgtatggcctaattaatctctgcccatggaaatcagatggaaagttctgattttctatcctgtgctcctacctgctaacatcattcacttgttaataattattgttttaaaaaaaaaaactcttgtcaatagacgtgtcagatttagacctgtggtttcagaaaaatttttggagcaaatttaaacatgtttggcactataggtaaatttgtatttaaaaaaaaaaacaatgtttgagtgtgcttttggtaatgctgagctttctttaaatggcttgtggagtcgtgaacttttgctaatgatgtggctccaaaaggtaatacatattaacattagactttaactttctgtaaaattggtttacttaaagttgggcggggggtgtgatactgtattagtattgttttaaagtggacactgtaacacgtgtggaaaaacaaataaatatgaaataaagttttaaa

SEQ ID NO: 3608 - DNA, 732 bp, Homo sapiens
gattgtggctcaccctccatcactcccaggggcccctggcccagcagccgcagctcccaaccacaatatcctttggggtttggcctacggagctggggcggatgacccccaaatagccctggcagattccccctagacccgcccgcaccatggtcaggcatgcccctcctcatcgctgggcacagcccagagggtataaacagtgctggaggctggcggggcaggccagctgagtcctgagcagcagcccagcgcagccaccgagacaccatgagagccctcacactcctcgccctattggccctggccgcactttgcatcgctggccaggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctagggtgtcgctctgctggcctggccggcaaccccagttctgctcctctccaggcacccttctttcctcttccccttgcccttgccctgacctcccagccctatggatgtggggtccccatcatcccagctgctcccaaataaactccagaagaggaatctg

SEQ ID NO: 3609 - DNA, 1480 bp, Homo sapiens
aaagtgctgggattacaggcatgagccgccgcgccccgccccacgctcagtcttgaaattgtctggaacgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgcttctactgttgctgctggcggcgggcggggcgcgcgcgcggtggcgcggggagggcaccagcgcacacttgcgggacatcttcctgggccgctgcgccgagtaccgcgcactgctgagtcccgagcagcggaacaagaactgcacagccatctgggaagcctttaaagtggcgctggacaaggatccctgctccgtgctgccctcagactatgacctttttattaacttgtccaggcactctattcccagagataagtccctgttctgggaaaatagccacctccttgttaacagctttgcagacaacacccgtcgttttatgcccctgagcgatgttctgtatggcagggttgcagatttcttgagctggtgtcgacagaaaaatgactctggactcgattaccaatcctgccctacatcagaagactgtgaaaataatcctgtggattccttttggaaaagggcatccatccagtattccaaggatagttctggggtgatccacgtcatgctgaatggttcagagccaacaggagcctatcccatcaaaggtttttttgcagattatgaaattccaaacctccagaaggaaaaaattacacgaatcgagatctgggttatgcatgaaattgggggacccaatgtggaatcctgcggggaaggcagcatgaaagtcctggaaaagaggctgaaggacatggggttccagtacagctgtattaatgattaccgaccagtgaagctcttacagtgcgtggaccacagcacccatcctgactgtgccttaaagtcggcagcagccgctactcaaagaaaagccccaagtctttatacagaacaaagggcgggtcttatcattcccctctttctggtgctggcttccaggactcaactgtaactggaaactgtgttgctctaaccctcctccagccctgcagcctccccttgcagtcatcattcgtgttctgtgtataccaaatgattctgttatctaaagaagctttttgctgggaaaacgatgtcctgaaaatggtatttcaatgaggcatatgttcaggatttcagaaacaagaagttagttctatttagcaggttaaaaaatgctgcattagaattaaagcaagttattttcttatttgtataatgacacaaagcattgggagtcagactgcttgtatattatcaaacattttaagagaattctaataaagctgtattttacatca

SEQ ID NO: 3610 - DNA, 1019 bp, Homo sapiens
ataaaggggtggcccgtagaagattccagcaccctcccctaactccaggccagactctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggaagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacctga

SEQ ID NO: 3611 - DNA, 1109 bp, Homo sapiens
accctcccctaactccaggccagactctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccacttcccctccactcctcagagccggcttcagacccaactaacgacactgaagattgagatggacgaagccaaggcacaggggacccagatgggggccgagaacggggcgctgacaggtgcgttggggtgtaagggagtgggcagggatagaagtgggaggagcctaggtgaatcctagttatccaaacaagcacagttgcaaacgtaatgcaaataacacggatataaacgcaaaaacttatgaaaagaatgcaaacaacatgcagaggccatgcaaatgtcacaaaaacaaggcaaatgccacaaaacatgcaaactccttgtaaacgactcacgaaagcaatgcaaacctatgaaaagctatgcaaatggcacgtggaagccatgcaatggtacacactaatttaattcaaataaaggaaagcgtgcaaacggcatgcagactatcaacttggattccggcgtgcgtggggcgggtgggcgcgggagtctccagcctgacccggctccctgcgcccccagaggccctggcgcgctgggaggcggcggccacggagtctacgcggcggctggacgaggctctgcggcgcgca

SEQ ID NO: 3612 - DNA, 1179 bp, Homo sapiens
atggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccaatgtggcaaggcctcacagaggtacctggcatatacagatcctgggctttcctctcagaccaaaccgaggactataccaactagttagagccactgtggtttaccgccatcatctccaactaactcgcttcaatctctcctgccatgtggagccctgggtgcagaaaaacccaaccaaccacttcccttcctcagaaggagattcctcaaaaccttccctgatgtctaacgcttggaaagagatggatatcacacaacttgttcagcaaaggttctggaataacaagggacacaggatcctacgactccgttttatgtgtcagcagcaaaaagatagtggtggtcttgagctctggcatggcacttcatccttggacattgccttcttgttactctatttcaatgatactcataaaagcattcggaaggctaaatttcttcccaggggcatggaggagttcatggaaagggaatctcttctccggagaacccgacaagcagatggtatctcagctgaggttactgcctcttcctcaaaacatagcgggcctgaaaataaccagtgttccctccaccctttccaaatcagcttccgccagctgggttgggatcactggatcattgctccccctttctacaccccaaactactgtaaaggaacttgtctccgagtactacgcgatggtctcaattcccccaatcacgccattattcagaaccttatcaatcagttggtggaccagagtgtcccccggccctcctgtgtcccgtataagtatgttccaattagtgtccttatgattgaggcaaatgggagtattttgtacaaggagtatgagggtatgattgctgagtcttgtacatgcagatga

SEQ ID NO: 3613 - DNA, 5734 bp, Homo sapiens
agatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcagaaactcttgaaagaaaaggactgtatatcttcaatctgacatcgctaaccaagtctgaaaacattttgtctgccacactgtatttctgtattggagagctaggaaacatcagcctgagttgtccagtgtctggaggatgctcccatcatgctcagaggaaacacattcagattgatctttctgcatggaccctcaaattcagcagaaaccaaagtcaactccttggccatctgtcagtggatatggccaaatctcatcgagatattatgtcctggctgtctaaagatatcactcaactcttgaggaaggccaaagaaaatgaagagttcctcataggatttaacattacgtccaagggacgccagctgccaaagaggaggttaccttttccagagccttatatcttggtatatgccaatgatgccgccatttctgagccagaaagtgtggtatcaagcttacagggacaccggaattttcccactggaactgttcccaaatgggatagccacatcagagctgccctttccattgagcggaggaagaagcgctctactggggtcttgctgcctctgcagaacaacgagcttcctggggcagaataccagtataaaaaggatgaggtgtgggaggagagaaagccttacaagacccttcaggctcaggcccctgaaaagagtaagaataaaaagaaacagagaaaggggcctcatcggaagagccagacgctccaatttgatgagcagaccctgaaaaaggcaaggagaaagcagtggattgaacctcggaattgcgccaggagatacctcaaggtagactttgcagatattggctggagtgaatggattatctcccccaagtcctttgatgcctattattgctctggagcatgccagttccccatgccaaagtctttgaagccatcaaatcatgctaccatccagagtatagtgagagctgtgggggtcgttcctgggattcctgagccttgctgtgtaccagaaaagatgtcctcactcagtattttattctttgatgaaaataagaatgtagtgcttaaagtataccctaacatgacagtagagtcttgcgcttgcagataacctggcaaagaactcatttgaatgcttaattcaatcattagtttatttttatggacttcttcctgttttttttttttttttttttgcactgccaatgcattttgtttcaaaagattatttctatagtcagaggggaatgagcaaatagactgaagattgccaccaaggaaaagaactgtatttgtttctgaatgtaacttaaagcaagatttttagtaaatatggacatctatttctctttttgtaatcaaacacaacaacttatcaaactgtttttagaactgttagagaacacactggtttatttttgtaatgttctttgaaaacagaatggagaagcagcaatagcttgtcatttatctcatttaatgactaatgggaaatagagaacaatttcgcgttttgaattaggcttattgccttagaatcctgagaaagtgctaaataatcaactctgatgtttttcttaagttcttgagactcttgtttatccttgtttttcctccacaagtcattgtctaagtgtaatggaaagtttatgctgagcgttagtgtgtatgtatgtgcgtacatgcgccaggtgcctgtgccctctgtaggatggtttgcttaatatggttttataattcagtttacacaggattctttattttttttaattttgtattttggcaaacaccattcagttataagaactttgccaaatatgatagaataattcaagagcatatacagagagttaccacttgacccagctatttaattgcaaatacagttgttttcatttcatttcctaccagaaaaaggaatcagaaacctagtttttgaaaacacaagtgtaattcctcttttgtacttctttttcacaaatgcttttatttattctaaattgaatttaaaaatccttcctaaagccattaactctttaattctcctgatatgcctttacttcctatgaagttattggtagatgttgaggcccaaaaactggtagaatattgaagatcttcttaaatgaccaatttaaccataaccaaatattgaatatcattcttcagtcacatctaagtcaggcactttttcacatagatcagggcttttggctcagtcacgaaatctacaagttagcaaagcttacaaaacattattcgtcaggtatgggaatcaaatatagacacttgtttgtctttgctttccatttctatgtgtcacatacatatatgtgtcctcttataactttagtcttcaaaattatttcaatatccttcttctcactatatttatttgtgtgatggaaatgctttcaggccgtagatcattgttggtgttaatctgtggttaatcctcattttagttccgtcttatctgatacttagaaatatctcagccattttggaggctgtgcagtatcagaagacgtggagtttgttctgtctctgcctgtagctaattatggtggttcagtcatttaataaatatgttttgagcatctattttgtgaaaggcactgtgttacctgtgtgtctttagtgtcctcactggtaaaatgaagaggctggccatgagctggaagggttaagtttataattccagctatttcacacccgtcttccttgaaggaatgatagtgatagatataaaaacactgtaagtccctcttttaataaactaaatgaaagaacatcctatacttcgctgtttgtaaattagtatggcattcgctttggtttaagtggtattttattgcaaacccattaaaagaataactcatgaaaagaagctctttgacaccttggggtacacaaatgttggtgtgggtgtgtgttaattctgtgagtgagacacaccagttctaaaaaaaatgagtgaagttctggtgcctgagttaccatgctttcttctagttcttacagtagcataaaattaaagattcaaagtgagatggaggataaaattactttttaatacatgttctcaaacatttgaaaataaaagtatatgatagaagggggccagagtgtggccaccatcctgatcgtactgtttttcaataaagaaaactttttcattggtagatttggtgaaattctaaatttaggtttttttctagagctgtatcaaccaaaacttctggcaattcccagtatcacttcttagccttcttatatccaaatgcctgtttattacctttcttaatttgaatcaatgcctagttattacagattgcaccccacaatggccaaaaacccactacataataaaatttacaggtactaactagttaagattatattttaagtagcaattgatataaaattacaacacaatgaaagaacttgggtaatctcttagcaatggaaataggttttaaccagcagtttttctgggtgctttgtaactatcattttactaatgaattgaggatgtattatggtttaaattggaagagttttattcccaaagaataaagcaagattatctttcagtagtagagattgaagtaaatgtattaatattttaattaatacagatttactaagagtagttagaaaatttagtaagtgcctgttttacaaattgttaggtactagtttctgtataattcctacacagaagctttagaaatctcctgatattaaattattaaattggcattcatgaaaagagaagctacaattataaactccatttgctaaatcatgcataatactctctctctctcttcccccacaagtaatctctctaccccatgcagtgtgcacacacacacacacacagtcagttactgaaaaaaataattctttttctttttttttttaaatggagtttcactcttgtcgcccaggctggagtgcagtggcgtgatctcggcccactgcaacctccacctcccaggttcaagcagttctcctgcctcagcctcctgagtagctgggattacaggtgtccgccaccatgcctggctaatttttttatttgataaaaagaattctttttctcaataactgttctcttgaattcaaattaagggactgccaaagtcaattagaatattttaaaaatactttgttgtaacctgtgtaaataatatacaatttacaggatttgggattgtagaacttaaactggaagactggattcctcagatctcaggactataacattccagataaatttttacattccctttgctgtatattaactgatgatcatttatatgttaagattttttaccttaatatttctgaataaaactcttattgcccatttaatattttcataggcaatcaaatgtgagtaatactgctaagagtctgatttattaaaaatatttgtataattcattcagtttagtttttcagtttagtctttctgctttcacttttctctgtgctaacaagtaactaatgtctgggcattgacttcttattgaatcaaagttgggttaggcatagctatgcacacctgatgtgtaagattaaagaagagattaaataagaaatcttgggtaagttggacttttctgtatagctcttttttcctctgagttgtattttaatgtagtttataagtgataaaatgatccttgttttctaaaagccagtccttcccttcagctttccacagtttctgtaaatgtttaatacttgtacagtcaatggcaattttaaatatatatatatatataatatatgtatatggaaaaggttcaaagatgcttttaatttatttaatgactattgccttcctataataataattttcatccttaattatgataatacttttagcaagaaaaattcctttttactacagtttttagatgcaaaatgcagtttggttctttagtcaaatccacttagagggtatattgcagtgaaactgtgaaggatacttcactaccaatgtataagctttgttgaatttgtatcattttctttcagtaatgaaaagctattcattatacagtatggaaataaaaattgcttcattga

SEQ ID NO: 3614 - DNA, 238 bp, Homo sapiens
tgttttttctattacctaaagtctttgaagccatcaaatcatgctaccatccagagtatagtgagagctgtgggggtcgttcctgggattcctgagccttgctgtgtaccagaaaagatgtcctcactcagtattttattctttgatgaaaataagaatgtagtgcttaaagtataccctaacatgacagtagagtcttgcgcttgcagataacctggcaaagaactcatttgaatgc

SEQ ID NO: 3615 - DNA, 1917 bp, Homo sapiens
ggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaa

SEQ ID NO: 3616 - DNA, 1784 bp, Homo sapiens
gaaggaagtggcgggggaaggagtgtggtggtggtttaaaaaataagggaagccgaggcgagagagacgcagacgcagaggtcgagcgcaggccgaaagctgttcaccgttttctcgactccggggaacatggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggt

SEQ ID NO: 3617 - DNA, 1705 bp, Homo sapiens
gaaaaacagagcctgtctgcggtggagtctcattatattcaaatattccttttaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaag

SEQ ID NO: 3618 - DNA, 1708 bp, Homo sapiens
ggcagaggaggagggagggagggaaggagcgcggagcccggcccggaagctaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaa

SEQ ID NO: 3619 - DNA, 505 bp, Homo sapiens
gctaaaggagcacaatgcctgatgctgcaggagaaacattaggagccattccgtagtgccatcccgagcaacgcactgctgcagcttccctgagcctttccagcaagtttgttcaagattggctgtcaagaatcatggactgttattatatgccttgttttctgtcaagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccgg

SEQ ID NO: 3620 - DNA, 3952 bp, Homo sapiens
ctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggttttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaatagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggagattataacacaagtgagcaaaaacaagcctgtaagaagcacgaactctatgtgagcttccgggatctgggatggcaggactggattatagcaccagaaggatacgctgcattttattgtgatggagaatgttcttttccacttaacgcccatatgaatgccaccaaccacgctatagttcagactctggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacggggaatttcctaaaattagtctggctcattttgactcttttcctatgtacaatatcatgtatatagtcatttttatttatttaaacgtatatattctcttctgtggaggctttatcaataaaatctatttcataggccactacattatacaatagatcatctagtataattttcaatgggttatgctgagtccattcaattccatttcaacatttttttctaatacaattttacataattttctgagattagacagaactcctttgactgtttaatattgtggaaggaaattgaataatttagttatattgtgccaatgaaaaccatgatagaatatttatttagaaataagacttaaaaaaataacaacccaaacaaaaattcttggataaacacaatttctcttttagagttcctgcttcattagataaagtgaaatgttgaactggatttgaataaataaacggtaggcagaacatagaagctgaaagattgcacagaattgttttaactgtttgctttaacagaagtggtgtaactgtaggagcatgttcctttttggcttgtggattgtagattttgcaaagagctcaaagcttcaggagacaggcttgagcctgtgtccatagctttccaagttaacactaattgtagtacaaccttcttacctcaaataaatcatgtctgcctattatctagaacactactgctgcagaatttttttttcagatttaaaaacctagtccaaaataaagaaacatttacatgtgctccactttcctccccacaggcaagagtcactgcatgcgtaaaatgtacaagagcagaagatgccgaaagaaccattttctttagctctcctttataactgagtttgctgattgatgtgatgcaagggattttatttagaagtaaaagcactgaaactaaactggaggaaattaccaaaagtcccagaatggctttgacagaattgccatttctaaagaacagctgaaattcatttttcatatctttgagagtgagctcaatgaaaaccttattttgtaaaggcattttgtaaaccttcttccaagcacaaataattccaaacaggaaggttctgttgtgtgtgtgtgtgtgtgtgtgtctgtgtgtgcatgtgtgttcttccctctaaaattaatttattttctctatctattagaatgccctctaaggcctttctttaacacacactgactttttgaagaatgatctttagattgataacttgctatttatggtgactctgtggttaggcttatttaccgttaatctaaagtattcataaagcaccatttattaatcatccttttggatctttcaaaccaaacgtataccaaaaatgtcttcaaaaatgttatggctttgtttgtaattcgggtatattaaaatgttgttttgaaatacagtttatcttaaagaaaatttgacagtaactatattaaggggtacattaagtaatatatttttaattaatggtgtaccattgagagaataagaaatggaagtctattgttttattctttaaatgtgctgtttaaatatatttccatattttaaaatatattaaacagatgctaatttctgctgttcttgatttggttctttatttaaaaggaatacaaaatgtaagtatatcataaattgagacaataagaatatttatcaaatgtaaactgtttgtggatcacatgattctttatgttgttcttaattgccaaaattgttttttgtgttgttaataattatctcactattaaatgtgcaaagcaacaatccatgaa

SEQ ID NO: 3621 - DNA, 1874 bp, Homo sapiens
gcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaatagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggagattataacacaagtgagcaaaaacaagcctgtaagaagcacgaactctatgtgagcttccgggatctgggatggcaggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacggggaatttcctaaaattagtctggctcattttgactcttttcctatgtacaatatcatgtatatagtcatttttatttatttaaacgtatatattctcttctgtggaggctttatcaataaaatctatttcataggccactacattatacaatagatcatctagtataattttcaatgggttatgctgagtccattcaattccatttcaacatttttttctaatacaattttacataattttctgagattagacagaactcctttgactgtttaatattgtggaaggaaattgaataatttagttatattgtgccaatgaaaaccatgatagaatatttatttagaaataagacttaaaaaaataacaacccaaacaaaaattcttggataaacacaatttctcttttagagttcctgcttcattagataaagtgaaatgttgaactggatttgaataaataaacggtaggcagaacatagaagctgaaagattgcacagaattgttttaactgtttgctttaaca

SEQ ID NO: 3622 - DNA, 2780 bp, Homo sapiens
cgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctggtggagtacgacaaggagttctcccctcgtcagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacagagactctgacctgtttttgttggacacccgtgtagtatgggcctcagaagaaggctggctggaatttgacatcacggccactagcaatctgtgggttgtgactccacagcataacatggggcttcagctgagcgtggtgacaagggatggagtccacgtccacccccgagccgcaggcctggtgggcagagacggcccttacgacaagcagcccttcatggtggctttcttcaaagtgagtgaggtgcacgtgcgcaccaccaggtcagcctccagccggcgccgacaacagagtcgtaatcgctctacccagtcccaggacgtggcgcgggtctccagtgcttcagattacaacagcagtgaattgaaaacagcctgcaggaagcatgagctgtatgtgagtttccaagacctgggatggcaggactggatcattgcacccaagggctatgctgccaattactgtgatggagaatgctccttcccactcaacgcacacatgaatgcaaccaaccacgcgattgtgcagaccttggttcaccttatgaaccccgagtatgtccccaaaccgtgctgtgcgccaactaagctaaatgccatctcggttctttactttgatgacaactccaatgtcattctgaaaaaatacaggaatatggttgtaagagcttgtggatgccactaactcgaaaccagatgctggggacacacattctgccttggattcctagattacatctgccttaaaaaaacacggaagcacagttggaggtgggacgatgagactttgaaactatctcatgccagtgccttattacccaggaagattttaaaggacctcattaataatttgctcacttggtaaatgacgtgagtagttgttggtctgtagcaagctgagtttggatgtctgtagcataaggtctggtaactgcagaaacataaccgtgaagctcttcctaccctcctcccccaaaaacccaccaaaattagttttagctgtagatcaagctatttggggtgtttgttagtaaatagggaaaataatctcaaaggagttaaatgtattcttggctaaaggatcagctggttcagtactgtctatcaaaggtagattttacagagaacagaaatcggggaagtggggggaacgcctctgttcagttcattcccagaagtccacaggacgcacagcccaggccacagccagggctccacggggcgcccttgtctcagtcattgctgttgtatgttcgtgctggagttttgttggtgtgaaaatacacttatttcagccaaaacataccatttctacacctcaatcctccatttgctgtactctttgctagtaccaaaagtagactgattacactgaggtgaggctacaaggggtgtgtaaccgtgtaacacgtgaaggcaatgctcacctcttctttaccagaacggttctttgaccagcacattaacttctggactgccggctctagtaccttttcagtaaagtggttctctgcctttttactatacagcataccacgccacagggttagaaccaacgaagaaaataaaatgagggtgcccagcttataagaatggtgttagggggatgagcatgctgtttatgaacggaaatcatgatttcccttgtagaaagtgaggctcagattaaattttagaatattttctaaatgtctttttcacaatcatgtactgggaaggcaatttcatactaaactgattaaataatacatttataatctacaa

SEQ ID NO: 3623 - DNA, 1844 bp, Homo sapiens
agaaagcccacgttggccgctgcggggagcgcggcgtggagaggcgggagaccgaattccggcgccgccgccgcggccgctgctcggtgcactagcccccttccttcccatcctttctgcgagcgggtttgctgggcagccgggcgaccgccgaacggaaagcaagatcctcgccgcctccgcttgaggaggcgtgcggcgcgcggagattttgagtgggagcgacggtgcccgagagctcaggggcgcggagttcgtgagcgagaaggaagttaaacctcgcggaatagactggcatttcgggacgccttgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctggtggagtacgacaaggagttctcccctcgtcagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacagagactctgacctgtttttgttggacacccgtgtagtatgggcctcagaagaaggctggctggaatttgacatcacggccactagcaatctgtgggttgtgactccacagcataacatggggcttcagctgagcgtggtgacaagggatggagtccacgtccacccccgagccgcaggcctggtgggcagagacggcccttacgacaagcagcccttcatggtggctttcttcaaagtgagtgaggtgcacgtgcgcaccaccaggtcagcctccagccggcgccgacaacagagtcgtaatcgctctacccagtcccaggacgtggcgcgggtctccagtgcttcagattacaacagcagtgaattgaaaacagcctgcaggaagcatgagctgtatgtgagtttccaagacctgggatggcaggactggatcattgcacccaagggctatgctgccaattactgtgatggagaatgctccttcccactcaacgcacacatgaatgcaaccaaccacgcgattgtgcagaccttggttcaccttatgaaccccgagtatgtccccaaaccgtgctgtgcgccaactaagctaaatgccatctcggttctttactttgatgacaactccaatgtcattctgaaaaaatacaggaatatggttgtaagagcttgtggatgccactaactcgaaaccagatgctggggacacacattctgccttggattcctagattacatctgccttaaaaaaacacggaagcacagttggaggtgggacgatgagactttgaaactatctcatgccagtgccttattacccaggaagattttaaaggacctcattaataa

SEQ ID NO: 3624 - DNA, 1543 bp, Homo sapiens
ggactgctcacgccaagggccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctggtggagtacgacaaggagttctcccctcgtcagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacagagactctgacctgtttttgttggacacccgtgtagtatgggcctcagaagaaggctggctggaatttgacatcacggccactagcaatctgtgggttgtgactccacagcataacatggggcttcagctgagcgtggtgacaagggatggagtccacgtccacccccgagccgcaggcctggtgggcagagacggcccttacgacaagcagcccttcatggtggctttcttcaaagtgagtgaggtgcacgtgcgcaccaccaggtcagcctccagccggcgccgacaacagagtcgtaatcgctctacccagtcccaggacgtggcgcgggtctccagtgcttcagattacaacagcagtgaattgaaaacagcctgcaggaagcatgagctgtatgtgagtttccaagacctgggatggcaggactggatcattgcacccaagggctatgctgccaattactgtgatggagaatgctccttcccactcaacgcacacatgaatgcaaccaaccacgcgattgtgcagaccttggttcaccttatgaaccccgagtatgtccccaaaccgtgctgtgcgccaactaagctaaatgccatctcggttctttactttgatgacaactccaatgtcattctgaaaaaatacaggaatatggttgtaagagcttgtggatgccactaactcgaaaccagatgctggggacacacattctgccttggattcctagattacatctgccttaaaaaaacacggaagcacagttggaggtggg

SEQ ID NO: 3625 - DNA, 3613 bp, Homo sapiens
gcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagactttcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttat

SEQ ID NO: 3626 - DNA, 3613 bp, Homo sapiens
agagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggagtctttcaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagactttcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttataga

SEQ ID NO: 3627 - DNA, 11461 bp, Homo sapiens
ggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgttttgtgttttattggcccttttctttattcagccccttaatctattttcagtcttctggcacgtaatttttttcacagttattattcttctattaacaaattatttttatctttcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatctatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgacaata

SEQ ID NO: 3628 - DNA, 3079 bp, Homo sapiens
gggggccggccagaaacgggctggggagggggggccccgcagcccccctgggccatgctgactcccggggcctgacccccccgggccagccccccctcccccagctccgcggcccgccgactggggggggccagcccagccccctggggacccccggagaggtggggggcagccgggggggccgggacggagcggtcgccggcccccaccggagagacggggcgacggccgcagggggggcggccgggggaccggtcgggccgggaccaagggcaccatgtcgtccggggccaaggagggaggtgggggctctcccgcctaccacctcccccacccccacccccacccaccccagcacgcccaatatgtgggcccctatcggctggagaagacgctgggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggc

SEQ ID NO: 3629 - DNA, 2095 bp, Homo sapiens
agcggctgggaggggtgggatgccagggttcctgagaggcaacgggctagggactcggacttatgggtcctgggggaagaggacacagctagagaaggagtctaggggtcagaggcaggaggggctaagctaggagtccaggactcccagaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggc

SEQ ID NO: 3630 - DNA, 1902 bp, Homo sapiens
agtctttcattgcgcgcctacatgtgcctacgacctcacttctgcttctctacgactcaccaccctcacagctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctcctcccctggtcctccccccacgaccttctgtacggatttgctctccggaaggaattctggtttcgcgtg

SEQ ID NO: 3631 - DNA, 1687 bp, Homo sapiens
attcgaagtggctcccacaaaagctgctgcagagccccagacattcagaagccaatagtgaaggggccaaaagccatccctcaatgttcactgacactttgcgagccttggggcaagttggcgatgtcaaaacatgtttttagggcgtgtttgccaacatacaggtcttgggcaggattgcagacctctgcagatggtaccaaagtaaagggggagatggtagctgaataatctcttatcatccctaaagtgcaaagtgaaatgagagtggatttttccttccaaatccacttggagtgagtcccgaaagactcacttttgcggcaatccccacaatgacatcactggagcggaggttatataatttaaagcaaccacatctccacagcacttcccagaagagaaaactcctccaaaagcagctctcactatcagaaaacccaactacagttgtgaacgccttcattttctgcctgaggtctcagtccgtcggcccagactgaagtgcagtggcacaatcatagctcgctgcagcctcgaccttccaggcttaaacgattctcccacctcagcctctcgagttgctgggaccacaggtcactgtgcatggcatcatcctggccccctctagagctccaatcctccaaccagagccagctcttccctcaaaatgctacggcctgtgacaatgctccagaagcctgggacctgctgcacagagtgctgccaacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaaggtgcgggggccgcaaggatagcaagaccacagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaaaacagcattgaaccaagaa

SEQ ID NO: 3632 - DNA, 4197 bp, Homo sapiens
atcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtat

SEQ ID NO: 3633 - DNA, 1600 bp, Homo sapiens
actccagctctggcttctgggctccgaggaggggtggggacggtggggacggtggggacatcaggctgccccgcagtaccagggagcgactgaagtgcccatgccgcttgctccggagaaggtgtggcctcactcacatcccactctgagtccaaatgttctctccctggaagatatcaatgtttctgtctgttcgtgaggactccgtgcccaccacggcctctttcaggtgaggtcattgtggttcaaggacgttaagtaacttccccagcgtcacacggcttataagtaaggcagccaggatgtgaacccagtaggactatctggctgcaaagtccccaccctccctcgccatctgtatcctccaatcatcttcagtgctttgctgatagaagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttg

SEQ ID NO: 3634 - DNA, 6845 bp, Homo sapiens
agagcggagagcgaaggtggccgcagccttcccggccccacagccagcctggctccagctgggcaggagtgcagagctcagctggaggcggagggggaagtgcccaggaggctgatgacatcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaagcccaggtgtggcctcactcacatcccactctgagtccaaatgttctctccctggaagatatcaatgtttctgtctgttcgtgaggactccgtgcccaccacggcctctttcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaattaataagcagcatctggtgctatactttggtctctagtgagttagctcatgaaagatgacagactctccaagccaggggtatgcaggaaatgggttttctgtagctacagaaatggggttgagggttggaccaaggggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagcatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtcccgtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtatctctcccgtgactcgtagttcagctcttcctccatgagcctgactatcagtggaccttccagaaagagccccttttccttctctcacccacagcacagggcactgggaaaatgcccaatgagtcctgccctctgggttgtgctttggacttttcagtgtgtcttcgcatccactcttcagcttgaatgttgcaacagccatgaaaaaagaaatgcaaagcgattcaggatgagagcaataccctactccaaagaaggcaaaatagaagctcagagaggtcaagcattttgcccaagaccacacagctaggagtggaactcatggctgtccaagccccacgcctctgctgaaggtagagatgaattacagcaacaagtctagaaaggtgcctgccctatggtctgtgagtcttgcctaagaatgaaagaggagccagtgggttaaagatgaggtcaccaacaaacggtggtgttggagtttaccactggttattttaatgggtttgcaagaattgttaattactaatgtttattgagcctagtgcagtgcttggggcattttgcacattgtctctgatccctatcacaaccctgagaggtagtttttttaactcccattttacaggtgaggtcattgtggttcaaggacgttaagtaacttccccagcgtcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactggccaaggaaatatcccagtggagcctcgagatgaagaacatgaggcccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcata

SEQ ID NO: 3635 - DNA, 4040 bp, Homo sapiens
gacatcactacccagcccttgaaagatgagctgttcccgccgccactccagctctggcttctgggctccgaggaggggtggggacggtggggacggtggggacatcaggctgccccgcagtaccagggagcgactgaagtgcccatgccgcttgctccggagaagcccaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccatctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaactggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctagaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgca

SEQ ID NO: 3636 - DNA, 1878 bp, Homo sapiens
gggcactgggcaggaaggggagggggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaattgtataaatggtgcaacagtaataaagttaaacaattaaaaagaa

SEQ ID NO: 3637 - DNA, 738 bp, Homo sapiens
agaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgacaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtga

SEQ ID NO: 3638 - DNA, 801 bp, Homo sapiens
gcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcggttctggaggctgagaagtccaagatcaaggcaccaacagattcagtgtctgatgaaggcttgttctctgcttcaaagatggcacctcttgctgtgttctcacatggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccc

SEQ ID NO: 3639 - DNA, 2831 bp, Homo sapiens
gctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggcatgctggaagatggactgccctccaatggtgtgccccgatctacagccccaggtggaatacccaacccagagaagaagacgaactgtgagacccagtgcccaaatccccagagcctcagctcaggccctctgacccagaaacagaatggccttcagaccacagaggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacat

SEQ ID NO: 3640 - DNA, 2662 bp, Homo sapiens
gggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacgagagctggacccgggagacagaatccacctggctcacctacaccgactcggacgcgccgcccagcgccgccgccccggacagcggccccgaagcgggcggcctgcactcgggctaaaagagatgctaagagaatgcctgcaaaagaagtcaccattaatgtaacagatagcatccaacagatggacagaagtcgaagaatcacaaagaactgtgtcaactagcagagagtccaagcagaagggcagatggacttcttcagtgtccttcacggcactggatcccatcaaagaaccttgaagaagtggctgccccttgctggacctgaattctactgagtccctggcaagactgtcttacctggcagcaaactgctgcctgatttgttgggaccttctgagccttctacttatcatgtaaatgtattggcacagtgcttacatatgttaataaactgcaaatgtgcagttcagtttgtctctttgcaactcctgtaatacggtctggtgtaaaagtagtgagttaaagctacaggtcagtttatgaaacagaaaagtaggaatgcattttctgggtgaaagagtcacaccttagtgctataactctcctgcccatgatagtgtattctgtttcaggcaagcttattctttccttctttcattttaaatattgtcattacaaatcttaccaggttcacttaaaagctggctttcatccaactctaaacccacatattgaaaaaatcaaggtacaggaaaactccttgttatccttgtttccttagcttggtatgagacagatcggatccagtttcccatgcaccaacccactgcccatggcatgtctttgggaggtgtctgtgaagcagtcatacctgctcctcatctgcctggaaagtcctcctattccagtgtccatgttggcctccagtccttaatgtcaccatgcttgtggccaatgcatccaaataaggatacccctcagggctcagctagacattgcaattttgcatagctttccagttccctttgcttgtcttcttgactgtcttccctctctatcggggtcacttgcaattgttaatcaaagattgaacactgcgtaggagagggagatgatccagagacatgtggcagcaggcatggcttccccttggcctctctgtacactgccccaggactgtcattttggcatctgcaaaggaatcactttagaaagccagcacctggttgatgtgtattcatactgacattagattgatgtgcactgcattagaaatgaggtagctgacacagaaaaaggatgttttgataggaataattttctagtatgtcttgaaacatgttcatctggaagtattttcctccaaagtaatgtagcatgatttttcaaggattgttaacatgcctgggattgggaaagataggactaaagttgtgccaaactatatcaataaattccatgtttagcagaaataggcagcctattggtgttatgtttatgtaacatagtccagagaactgacatgcaggtcaaaagtcagatacgcaacctccttatctgctaactctgttattcttcaaacacaagtgggtagtgtcatttttccttccttccttccattggcagattgtatatttattcacaaaacattaaatgtccatcctgtgccaggtactatgcagatgttgagggatttggggtctggttagtcgtgactatctatcctgaatctaacagtgacttcataactaggagactgaattagacccttaaggtatagtgtgtgttgcaaatcactctgcaatggaaacttttatattcagggtaggtttgtgtcttaaactaggtgttctaatcaatgtacaagactttaccatacacgcaactatagtttttctaaaccttcatcattttgtgattctttgagaaagggcttttaggaactttatgttctaaaaaatgtttttaacaataataagataaaagaaaaacctgtgattcatatgtccccactggcattactcagcaggagcccccagctgccaaaggttggcagtgatcctgcaagttcaagggctctttctccctggggatgtgctttgtggcttctctttacagctttgtttctgcatcagttcactgctgcatgttgtttggaatttatcaccttaagaaagtgtctctgttttatatagaaacactttctcacttacaggggagaaggaaatgcagggcacatgatctggccctccccagaacaatctggatttcacggagacagcaaccagaagttaaaccatgtgactaaaaatgcatctggctactttttcatgtatgtatgagacagaaactaatccttactatcctattaggataccacttttcattgcaaagtttgtgtcaataaagtcattaattttaaacata

SEQ ID NO: 3641 - DNA, 668 bp, Homo sapiens
cgtgatcggccaacactgagtcttacctcgttgtggcgtcagaaccgccgtcgctcgctcccttctcggcagtggtacctgttcccggtgtccctgaggacgtgcgggccaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttga

SEQ ID NO: 3642 - DNA, 899 bp, Homo sapiens
gggacgggggcggagcctctggcgatgacaacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagca

SEQ ID NO: 3643 - DNA, 736 bp, Homo sapiens
tggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaa

SEQ ID NO: 3644 - DNA, 1077 bp, Homo sapiens
gctcgctcccttctcggcagtggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagtttt

SEQ ID NO: 3645 - DNA, 864 bp, Homo sapiens
cttggcggtgacgcacggccctcacgtgaccgggagctgcagagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggaggaggtgagacagctgatggaaaagctgagggaaaagcagttgagtcatagtctgcgggcagtcagcactgacccccctcaccatgaccatcatgatgagttttgccttatgccctgaatcctgatggtttccctaaagttattacggaaacagacccctgctttcgaatttacatgttcatgatgtgcccttgttgtaaacctttacctgtcacttgtttacgtgggtctcctattaccagcttctaattgaatattgtgtttttgaaccagtctgtaagatttttgttagcagaagaattttacctattgcatggaaagatgctcattatagtgaagttaataaagcacctttaaaaagcaa

SEQ ID NO: 3646 - DNA, 1066 bp, Homo sapiens
tggcgtcagagccgtcgtggctcgttccattctcggcggtggtacctgctcccggtggccctgaggacgtgtgggccaggggcggccccgaaattaggaagcggagggggagcaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggggtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagt

SEQ ID NO: 3647 - DNA, 1328 bp, Homo sapiens
gtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggggtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagataaatctgactttgatgggcaagtaattaaaaaagaaaagtatgagaccttaaaa

SEQ ID NO: 3648 - DNA, 857 bp, Homo sapiens
atggtaattggaaatctgagctcacagtgacgtgacccttaggagacccagagccaatgcgtggattagtccctcctcctagttgcagtctggtagttgtcgctggccgtgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaaacaggaaaaaaactcaacatggaaaatgtccccaaggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagca

SEQ ID NO: 3649 - DNA, 860 bp, Homo sapiens
caccctttccagatacacacccgtttagtgcgagaaatggagcggttggggagaggatctcccgagggggctggattgagaatgggtaccatttgagatctcctaggaggccggccatcgggcaatgtctgatggagtccagccggtggaggagactgaaaggaaacagcctgcttcctgcaggtccgcgggagggaggtctttaagtgcgtttgtgcagccgatttcaaggctaagagagaaagactgcctctgatccctgaaggaagaaaaaaaaaaaaaaaacaggaaaaaaactcaacatggaaaatgtccccaaggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagcagtct

SEQ ID NO: 3650 - DNA, 780 bp, Homo sapiens
gcgtctgcctcagaggggcccgagccacccggtccgccgcgtccccgccgccgccgccgcgtcccccgccggggccgaccgagccgagccgggccggagcggcgggcgcggccgggccgccatggaccacaagccgctgctgcaggagcggccgcccgcctacaacctggaggccggccagggcgactacgcgtgcggcccgcacggctacggcgccatccccgccgcgcccccgccgccgccctacccctacctcgtcacagggatacccacccaccatcccagggtctacaacatccacagccggaccgtcacccgctatcctgccaactctatcgtggtcgtaggaggctgtcctgtctgcagggttggggtgctggaggactgcttcaccttcctgggcatcttcctggccatcatcctcttcccctttgggttcatttgctgttttgccttgaggaagcgacgatgccccaactgtggagccaccttcgcttaaagggaacaccaggcccggctttcctacacccagctctctttttctaatgtaaatgttgtgtacaataattttatttgattaagcttcaggactgttttgtaaagcgaggtgggaccgatgtggcacacgccagctgcggtttcccggagcgtggagaggcagtgctgctgctcccgcccgaggctcatgacaactcaataaagcactgcttttattttttgcagtcttcaatttgagaaaggtgagaaataatgttttcaataaatgagattcataccatt

SEQ ID NO: 3651 - DNA, 699 bp, Homo sapiens
cccgccccgcgtctgcctcagaggggcccgagccacccggtccgccgcgtccccgccgccgccgccgcgtcccccgccggggccgaccgagccgagccgggccggagcggcgggcgcggccgggccgccatggaccacaagccgctgctgcaggagcggccgcccgcctacaacctggaggccggccagggcgactacgcgtgcggcccgcacggctacggcgccatccccgccgcgcccccgccgccgccctacccctacctcgtcacagggatacccacccaccatcccagggtctacaacatccacagccggaccgtcacccgctatcctgccaactctatcgtggtcgtaggaggctgtcctgtctgcaggcaccagaggtcatcctggctttacacgtatcctttgagagtctgtacctgattcaaacacggagaaaccaggaccccgagcagtttgagtgtactggtaatggatgcagctttggccaactagctgagtgagaacacaaggagccgtgactccgacgcccaggcctgtgtcctggatgggccgtgtgcagcgaatccgttggcgactcctaactaccaagaaaaggagctctcggaggagatttcgtcgagtgctacgtgtggctgtgataagggcaggcaaagcgtcttagcactctacagctctggcgtggttggagggagg

SEQ ID NO: 3652 - DNA, 3622 bp, Homo sapiens
ctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttgtccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgcccgactgtgacgaatgatcgctcggcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaac

SEQ ID NO: 3653 - DNA, 5312 bp, Homo sapiens
ttttctgcacccgccgcccgggagagcgggagcctcggccctccgcgcggctgcagctacctaccctgcgcccggcccggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgg

SEQ ID NO: 3654 - DNA, 5400 bp, Homo sapiens
gccgcccgggagagcgggagcctcggccctccgcgcggctgcagctacctaccctgcgcccggcccggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 3655 - DNA, 5403 bp, Homo sapiens
gccgcccgggagagcgggagcctcggccctccgcgcggctgcagctacctaccctgcgcccggcccggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 3656 - DNA, 4675 bp, Homo sapiens
gatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgc

SEQ ID NO: 3657 - DNA, 5176 bp, Homo sapiens
actcggcccggcgcgcgctgcgggcagcggccggagcggccggaggaaccgggttcggcggcagcggcggcggcgctcagagaccgaagaggatgcggcaccggctctcagagcccggggctgcggccgccgcccgcaaataggaggcggcgcgcggcgcgggcggtgctcggggcgggggagcgggggagcggggggcggcgcggcaaggaggcggcggcggcggcggcggcaggagcccgcgcccggcccggcgccgcccgcccgcccgccccgcgctgctccgcggcgccttttctgcacccgccgcccgggagagcgggagcctcggccctccgcgcggctgcagctacctaccctgcgcccggcccggtccccgacttagggatggcaaacttgcgccccgtggccgcccccgccagcgccggcccccgctcctgctgctgacggcgcccagggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 3658 - DNA, 4857 bp, Homo sapiens
ccagcgccggcccccgctcctgctgctgacggcgcccagggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 3659 - DNA, 4879 bp, Homo sapiens
ggggagggagatccagcttcagacatgcaaaggaagaccccgcagaggatcctgcctgacacttagctgtcatatgctgagcctcagagggccagatactcatggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 3660 - DNA, 2541 bp, Homo sapiens
ggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccag

SEQ ID NO: 3661 - DNA, 539 bp, Homo sapiens
accgcccccaggggccgagggctgccccttgtcccccttccagttctgcccgcgttttcctccttaaggaggaaccccctcccctaagagagcgaccctctctggcagtcggagcgggaggactgcacagagggggtcgctccctcccctcggcccagtccccagctccggaggcaggatggagggtgtgcgtcccccagggcgacagagctctaggagagcggctcctgaggaccctgtccttgggtccgagcgctggcagaggacccaaagccaccgagtgggggtcaccgcctgcgtggcggcctgggcaggtcgggcggcgagcgccggggaggcggagggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatgga

SEQ ID NO: 3662 - DNA, 3702 bp, Homo sapiens
ggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccg

SEQ ID NO: 3663 - DNA, 4919 bp, Homo sapiens
cagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttc

SEQ ID NO: 3664 - DNA, 2927 bp, Homo sapiens
atatgctttagcattttaaatggctacaccaaagagaaaattgaaccaggctctcttccctactcctactggactttggggtggggttattcctctgaatgttctagcggacttggggttagcttaatgcttctgccccagggcaaagaagcagttgagggaaagaaatgtcaaggacgtcagaggcgagctggactgagtgaagtgtggagtaggaagcttaggaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccgcatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctac

SEQ ID NO: 3665 - DNA, 6010 bp, Homo sapiens
ctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaagaacagtggaagagactgcagcctaaagacttttaaaattaacttggcatcacttttatcagctcaaaggctaaacaaacaaacaaaagcagtgtcatttattctaagaaataacttcttaaaggttaaagctgaaaaatattcaagttatttttggataacaacttacagaggccaaatgacataggatgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaagaatttggaatgatgggagatcatacaattaaaagtcagcgacctcgatctgttcatgaaaaaagggtccctcaggaacaagctgatgctgctaaatttatggcacaaactggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcaatgagcagcgatgccctgcaccttatgaaatatgccctgaggattatctgatgtcgatggtgtggaaaagaactccagcaggcgacttggcattcaatcaatgtcccctgaatgccacaggcaccactagcagacgctgctctctcagtcttcatggagtggccttctgggaacagccgagctttgcaagatgcatatcaaatgagtacagacacttgcagcattcaattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccagaacttctttcaaatagttagcaaccttctagatgaagaaaacaaggaaaaatgggaagatgcacaacagatttatccagggtcaatagagttaatgcaggtgattgaagattttatacacattgttggaatggggatgatggactttcagaattcatacttaatgactggaaatgtagtggctagtattcagaagcttcctgcagcctctgttctaacagacatcaactttccaatgaaaggacggaagggaatggttgactgggcaagaaactcagaagatagggtagtaattccaaaaagcattttcactccggtgtcatcaaaagaattagatgaatcatctgtatttgttcttggcgcagtcctatacaaaaacttagatctaattttgcccactttgagaaattatactgtcattaattccaaaatcatcgtggtcacaataaggcctgaacccaaaacaaccgattcgtttctggagatagaactagctcatttggctaatggtactttgaatccctattgtgtattgtgggatgactccaaaacgaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccgcatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctacatatca

SEQ ID NO: 3666 - DNA, 1882 bp, Homo sapiens
gtacatagatgaataagtattctcttgattaagtggtatcttgtcaggaaactatgaagagtgactcttcctaagtccatacttaataggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccgcatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaa

SEQ ID NO: 3667 - DNA, 4319 bp, Homo sapiens
acgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagac

SEQ ID NO: 3668 - DNA, 4694 bp, Homo sapiens
tgattgacaagaccacgaggctgagcgcgccctggagatttttctataaatggcttaacaccccagtctagactatttgctcggatataagggagacaattgtttttttgttctttgccggcgaaccctggctctgtagggctgacctggaatttaaccagtcttccctgagccggcggaggaggacaaaaaccgccgcgaccccggcagggtgggaagtgcagggcagcgctcccaagacacgcttgttggaggttcgggcctgggtgcttggttgtctgagcctccttttttgtgtttgcctgggtcctggagaggagcgcacggtatcatggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagacaaaaaaaaaaaaaaaaaa

SEQ ID NO: 3669 - DNA, 1811 bp, Homo sapiens
gcttggccacaccgcctgctttcgcttccagccgcgcgctccgtgccactgccgctctctgcagccccgcgtccccgcagcctccccatggccagcccgcttcgctccgctgcggcccttgcccgccaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaa

SEQ ID NO: 3670 - DNA, 1360 bp, Homo sapiens
gcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttg

SEQ ID NO: 3671 - DNA, 8335 bp, Homo sapiens
agtagggaggtgggcaggagccagtgatgacggaatggcaatcacatttgacctctgatctgtttatttcctcctccttgacgtctccatataaatgttacacgggcatccccacactcggatacgcacccacagtggctgattcgggggtaaccgtgtcatttgcttgcaacactggcacctctgccctgcaccccgggagtgagcagtgagtgaggctcgggtctgggcgctggctccgaatcttcgggctgggagagactccaccatctgggggcggcctgggggagcagccttagtgtcttcctgctgatgcaatccgctaggtcgcgagtctccgccgcgagagggccggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagacaaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccatattagttttgttgcttcataaaatttacctaagcaagtggtcttgcttgcctcaaatccaagcagtcttgaacacttggaggcaattaatgagtatatcttagtcaaaagaattgttggagctttttattaaagctacagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacattgtttgttcactttcaaagagtgatagtttctaaaacatttagagcaataaatattcatcagaggtaccaagtaagccggcagaagagttaagggttagagaaatcccttatttcatgtcttgactctaaaattatcaaagtacttttccttgtaatgtggatttcttcttatgcggatatgcaaaaacttcagttatacgtagtaatgctagcaggtaattttagtagacattttataacaactgtcactttgtttcgccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatggcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactattggattctggagaaaaatttaatgaaagatgatatcagaggaagaataagtggaggtagagaagaaaggaatgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgacttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtt

SEQ ID NO: 3672 - DNA, 1596 bp, Homo sapiens
aacgtctctcttcggagccgcgccccgggcgggcacagttacgcgccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacac

SEQ ID NO: 3673 - DNA, 2041 bp, Homo sapiens
agttacgcgccgcacggatcatggccgcagccgctctggggcagaagcatggctgcaaggctgagcagtctagatgtcgccacccaaaggcaatctggggacccacgctctgatcaccccggaatccctggagcctcacaccagcaagaccacgctgcaggcccatctcccagcaactcacctagcgacaagtgaccacgcccattcacgtccatcttccagaatcagtgccaactcacccagctcacagggcaggccaggccaggccactctgtctctctcaacctcacgccccaacgcctccccacagggctggggaaagaggccttgtgaggtcaaaggtcaccagagagggcccagcctgctggacacagccagacctgctcttcctactcccctctgggaggacccgcctgagcctcatgcagtgaggactgcagtggctccccaggcccctgtagctgcccctcagccccaggggctgaagggaattggagtcactgccaaaatgggtttgtatttcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacac

SEQ ID NO: 3674 - DNA, 1320 bp, Homo sapiens
aacgtctctcttcggagccgcgccccgggcgggcacagttacgcgccgcacggatcatggccgcagccgctctggggcagctgtttgagggcatgaaggcgttcaaaggcaaagaccagcaggtgcgcctcttccgcccctggctcaacatggaccggatgctgcgctcagccatgcgcctgtgcctgccgagtttcgacaagctggagttgctggagtgcatccgccggctcatcgaagtggacaaggactgggtccccgatgccgccggcaccagcctctatgtgcggcctgtgctcattgggaacgagccctcgctgggtgtcagccagcccacgcgcgcgctcctgttcgtcattctctgcccagtgggtgcctacttccctggaggctccgtgaccccggtctccctcctggccgacccagccttcatccgggcctgggtgggcggggtcggcaactacaagttaggtgggaattatgggcccaccgtgttagtgcaacaggaggcactcaagcggggctgtgaacaggtcctctggctgtatgggcccgaccaccagctcaccgaggtgggaaccatgaacatctttgtctactggacccacgaagatggggtgctggagctggtgacgcccccgctgaatggtgttatcctgcctggagtggtcagacagagtctactggacatggctcagacctggggtgagttccgggtggtggagcgcacgatcaccatgaagcagttgctgcgggccctggaggagggccgcgtgcgggaagtctttggctcgggcaccgcttgccaggtctgcccagtgcaccgaatcctgtacaaagacaggaacctccacattcccaccatggaaaatgggcctgagctgatcctccgcttccagaaggagctgaaggagatccagtacggaatcagagcccacgagtggatgttcccggtgtgaagctgcaggctgtgctccagatccaccgacccgtagcatctcgtcacgccagcactcgcctccctaccaatgactcacctgaagtgcaatacgaaataaaaggccagcgggcggcgtctgggtctctggcgcccccatgtggttgcgacactcccaaagccgtaagggccgacccaggcatcttggcccccagcccctcgtcgcgggttcaggtccgcccattactccttgtcgtgcggtcaaggatacaccttggccccgattccggatctctccgttctcaggccagacccctggtgctgccgttgatttttttttctctgtctttgctgcaattttgaaataaaatgccaaagaacac

SEQ ID NO: 3675 - DNA, 2103 bp, Homo sapiens
accaacaatctggctccgcccagtcccacctcctaactctggcaacgccattggacatttgggaacagaaggcaggccttggcattgatccgctttactctgggcccccgggccctaaatccctgaggccctggtcaggttgccctcttctttgcctgttacaggagtaactacaatgaggcgattggagaaaattttgggtagatagatttttttttctccaaatctctgtgcattctatctaccacagaacgggaagaagatggttttcttgtcagatggtgctggagtttgcgtcaggcacataaagaggcagccccgaatctagcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctctacca

SEQ ID NO: 3676 - DNA, 1213 bp, Homo sapiens
gatggcggtagcgatcgctgcagcgagggtctggcggctaaaccgtggtttgagccaggctgccctcctgctgctgcggcagcctggggctcggggactggctagatctcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacctgccgaaggagaaggtgctgaagctctacaagagcatgacactgcttaacaccatggaccgcatcctctatgagtctcagcggcagggccggatctccttctacatgaccaactatggtgaggagggcacgcacgtggggagtgccgccgccctggacaacacggacctggtgtttggccagtaccgggaggcaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcaggcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattgcagcacgaggccccgggtatggcatcatgtcaatccgcgtggatggtaatgatgtgtttgccgtatacacagccacagggggtcccaaggcacgtgcttcagttggtccctcatctccgtcaaccacaggcacttgtgggattatgatgccattgcatgccatgggcctctggcatcctgtttcccatcagcaagagctcagcgcggcgcccaagcccaaaggcacaaccaaaccaatcctggaatcctatcttaagagtcatctcctgggacactccaggtatcaactctatatccatcaggatgcagtcaggagagaaaaaccacagagtaacttgaacagggaaagtttaatatag

SEQ ID NO: 3677 - DNA, 3676 bp, Homo sapiens
aggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctgagtagttgggattacaggcgcccaccaccatgcccagctaatttttgtgtttttattggaggtggggtgtcactatgttggctcagctgatttcaaattcctgacctcaagtgatccacctgccttagcctcccaaagtgctgggattacaggcatgagccactgcacctggctatatttacatttaatagaaacatatctagcatatgtatatgtgattttttttttttttttgagaccgagtctcactctgtcaccaggctggagtgcagtggtgcgatcttggctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgccttggcctcccaaagtgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcagctacttaaactgttcatgaataggcgtactttctgtatttaaaaatggcccctcaagcaccgttaatttacattccagttatttacatgataattcatgacattctgaaacttgcctgtatattatctgaaaaatggatttcttgagcaaaagatctgtttattgtatgtaaggaaaaattttacctgaaaacaaacaaacaaaccctaaaactcagcaccactaccatttccagaagcttttttaacaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatatgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcatgtattctctcagacataccggtgtagatgctatatttctgatgtcttcttaatgtctgtgaaagcaactggcatctacaataaatcacacttagagctggttagaggactccttcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaa

SEQ ID NO: 3678 - DNA, 1514 bp, Homo sapiens
aggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatatagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaa

SEQ ID NO: 3679 - DNA, 743 bp, Homo sapiens
aggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaagatcaaagttataagcttatcttagttgagtagatgttgcctgatttttgaatgtgagctagaa

SEQ ID NO: 3680 - DNA, 1285 bp, Homo sapiens
gagaatcccggtggtgagcggggatggcggttgtagcggcggctgccggctggctactcaggctcagggcggcaggggctgggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggt

SEQ ID NO: 3681 - DNA, 3767 bp, Homo sapiens
agcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaagatcaaagttataagcttatcttagttgagtagatgttgcctgatttttgaatgtgagctagaagttgtagactgggaaagaagccatgtgcgaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctgagtagttgggattacaggcgcccaccaccatgcccagctaatttttgtgtttttattggaggtggggtgtcactatgttggctcagctgatttcaaattcctgacctcaagtgatccacctgccttagcctcccaaagtgctgggattacaggcatgagccactgcacctggctatatttacatttaatagaaacatatctagcatatgtatatgtgattttttttttttttttgagaccgagtctcactctgtcaccaggctggagtgcagtggtgcgatcttggctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgccttggcctcccaaagtgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcagctacttaaactgttcatgaataggcgtactttctgtatttaaaaatggcccctcaagcaccgttaatttacattccagttatttacatgataattcatgacattctgaaacttgcctgtatattatctgaaaaatggatttcttgagcaaaagatctgtttattgtatgtaaggaaaaattttacctgaaaacaaacaaacaaaccctaaaactcagcaccactaccatttccagaagcttttttaacaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatatgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcatgtattctctcagacataccggtgtagatgctatatttctgatgtcttcttaatgtctgtgaaagcaactggcatctacaataaatcacacttagagctggttagaggactccttcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaagtgaaccatcacgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 3682 - DNA, 3179 bp, Homo sapiens
agcgacggcggccgggaggcggaagtggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcggccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacatcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacagg

SEQ ID NO: 3683 - DNA, 1549 bp, Homo sapiens
tttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacagggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgc

SEQ ID NO: 3684 - DNA, 3434 bp, Homo sapiens
cctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcagggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcc

SEQ ID NO: 3685 - DNA, 3937 bp, Homo sapiens
cgctccgcccctcccctcgcagcacccgggcctagtactgcccgtcccgcccctcctctcgagcctcagcgctcagcatcgcccggaccccctcttcccttcgcccgcctcgtcccgaccctccccttcgcccccgtcccgccccgcccctccccttcgcccccgtcccgtcccgccccgcccctccccttcgcccccgtccctccccttcgcccccgtccctccgcgcgtgcgcgttcgccttcgagcgcatgcccgcatctgctgtccgacaggcggaagacgagcccagaggcggagcagggccgtcgcgccttggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctg

SEQ ID NO: 3686 - DNA, 1101 bp, Homo sapiens
aggcctgggcggagcgcacagcgctgggcgctggggaggctgcgccgcagcacccggttggtcaggaccaagtgggcccgaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaagtaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttac

SEQ ID NO: 3687 - DNA, 2496 bp, Homo sapiens
gagcgcacagcgctgggcgctggggaggctgcgccgcagcacccggttggtcaggaccaagtgggcccgaggcggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaa

SEQ ID NO: 3688 - DNA, 2846 bp, Homo sapiens
cggacgtgagaagggtcgggccaagatggcggtgcaggtggtgcaggcggtgcaggcggttcatctcgagtctgacgctttcctcgtttgtctcaaccacgctctgagcacagagaaggaggaagtaatggggctgtgcataggggagttgaacgatgatacaaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagaggcagagaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtcccttcatggtccacgagacttctggagctccagccagcacatctccattgagggccagaaggaagaggaaaggtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataaatcaggagacaaaatggggaaagatgaaaatatccagtgtaaagttacttaagctaaatcaatttcaaagaagaaaaacttggaggactcattttacctgacttcaagacttactataaagctatagtaatcaagatagatggtattggcagaggaacagacacatacgtcaatggaacagatgagagaacccagaaataaacccatataaatatgctcagctgattttgaaaaagtgaaaaagcaattcaatggaggaagaatagcctttctgacaaattatgctagagcaattagacacccatggcgaggagaaaaaagaacctctacttaaacctcacatcttatataaaatttaactcaaaatgtataacggacttaaatgtgatacataaaactagataactttgaaaaaagccacaggagaaaaatcttcaggatcttgggctaggtgacaagttcttggactttgccccgaaagcacatccataaaagacaaaatctgatatattggacttcttcaaaatttaaaaacttgtgatttaagaagaggaaaagataagctacagattgagatgaatttgcaaaccatatatctgatcaatttggaatatataaagtgtactaaaaactcaactgaagtcaggcatggtagctcatgcttgtaatctcaccactttgggaggccaagatgggaggagtgcttgaggttaggcgttccagaccagcctgggcaacatagtgagactcttgtctctacaaaaagtttttttaaaaaattaactgggcaccatgacacacaccagtagtcccagctactagggaggcaggaggatcacttgagcccaggagtttgaggctgcggtgagctgtgatcacaccaccacactccaacctgtgtaacagagtgaggcctcatctcaaaaaaaaaaaaaggccacaaaactcaacaataaaaacaaacagtccaattagaaaatgggcaaaagacatgaatagatgtttcactgaagaggatctatagatggcaagtaagcatatgaaaagctgttaaactccataagtcatcagggaatgcaaattgaaaccacagcgaggctatgacttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaacagattaatggttgccagggatagggactggagggggtgtggggtatgtatgactataaagggatgacgcaaggagttcctttgtgctgatggaacagttctatatgattatgatgattacgatgttgattataacatttgattatgaggttaagcacatgagtctttacctgtgctgaagttgtatggacctacatacacacaaatgaatgcatgtaaaatctggtgatactgaataaagtctgtggtctagatagcagta

SEQ ID NO: 3689 - DNA, 954 bp, Homo sapiens
atggcggtgcaggtggtgcaggcggtgcaggcggttcatctcgagtctgacgctttcctcgtttgtctcaaccacgctctgagcacagagaaggaggaagtaatggggctgtgcataggggaggtgagtagtcccagtaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagagacacacaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagagtcccttcatggtccacgagacttctggagctccagccagcacatctccattgagggccagaaggaagaggaaaggtatgagagaatcgaaatcccaatccatattgtacctcatgtcactatcgggaaagtgtgccttgaatcagcagtagagctgcccaagatcctgtgccaggaggagcaggatgcgtataggaggatccacagccttacacatctggactcagtaaccaagatccataatggctcagaagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataa

SEQ ID NO: 3690 - DNA, 747 bp, Homo sapiens
atggcggtgcaggtggtgcaggcggtgcaggcggttcatctcgagtctgacgctttcctcgtttgtctcaaccacgctctgagcacagagaaggaggaagtaatggggctgtgcataggggaggtgagtagtcccagtaggagtgactccaaatttgcatatactggaactgaaatgcgcacagttgctgaaaaggttgatgccgtcagaattgttcacattcattctgtcatcatcttacgacgttctgataagaggaaggaccgagtagaaatttctccagagcagctgtctgcagcttcaacagagacacacaggttggctgaactgacaggccgccccatgagagttgtgggctggtatcattcccatcctcatataactgtttggccttcacatgttgatgttcgcacacaagccatgtaccagatgatggatcaaggctttgtaggacttattttttcctgtttcatagaagataagaacacaaagactggccgggtactctacacttgcttccaatccatacaggcccaaaagagttcagaccttacacatctggactcagtaaccaagatccataatggctcagaagtgtttaccaagaatctgtgcagtcagatgtcggcagtcagcgggcctctcctacagtggttggaggacagactggagcaaaaccaacagcatttgcaggaattacaacaagaaaaggaagagcttatgcaagaactttcttctctagaataa

SEQ ID NO: 3691 - DNA, 2183 bp, Homo sapiens
actgggtagaatacttggggtgccagggaggcattaatgcgagaggagtcaggtgctcagtttttattggagttgggagggcagccccacatcaggaagagaacctgtttctgcaggatggtccggggagaagggaggactccacccaggcttgtgtttgccctgctctgtgtattcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaaggtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtacacagggaagtgtgtcttctcccatgtcaagaagaagtggcctttccaggaatggagctattga

SEQ ID NO: 3692 - DNA, 3303 bp, Homo sapiens
gtattcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaa

SEQ ID NO: 3693 - DNA, 1160 bp, Homo sapiens
gcaggagcagctccgggtgacacgaggggactgaagatactcccacaggggctcagcagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggtaagtgtgccaaggtgtatccacttggttctgaatgcatgctcgggggcgctaatgggataagaccactgcacatatgcagtcaccctgggcctaggcaaggtggcaagctgttgacccctctagaacaaatagcacattgcagcagagtgtcatcctgatgtttctctgggtagaaacttctgtgtgaagaacaataacagctgtggcatctgttttatgtaaaagaaaagaggaggtgagttacatgcagatgaatttgtccatccatttttcaaaggcggaagtagacaggttgcgtttacgatcagtggattctggaggaaaaggcattagtggaataaaaatgattcctaaaagatgttacctagtctctgtagtttgttgacatgcagagttttgttggaacacatttcgtcccttactgttaatagcctgaattgatatttaaccatcttttgctctaaggtgtgtgtttgaataaggagattttacagctctgggcagactcttttatgta

SEQ ID NO: 3694 - DNA, 1337 bp, Homo sapiens
ataatctcatgattgttctgcacgcctgtgggcagaagaagtatggctggaattagggggtaagagagaaaggggtgtgaagcaaaagtatgactttgagagttcacattcagcaagtggcaactgtgacaactgttttgcccctaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatg

SEQ ID NO: 3695 - DNA, 2537 bp, Homo sapiens
atgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccattttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaag

SEQ ID NO: 3696 - DNA, 1299 bp, Homo sapiens
tgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggctgcagcgctggtggaggaggaaactcgcagataccgacctactaagaactacctgagctacctgacagccccggattattctgcctttgaaactgacataatgagaaatgaatttgaaagactggctgctcgacaaccaattgaattgctcagtatgaaacgatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgaaaatctagttcatatgattgaacacgcacagaaggaacttcagaagttaagaaaacatattcaagatttaaactggcagagaaagaacatgcaactcacagctggatctaaattgagagaaatggagtcaaattgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactttgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaa

SEQ ID NO: 3697 - DNA, 1109 bp, Homo sapiens
ggagctgcgagccgcgaccgccgggagcgcacctgccccgcctccgccaggcggtccgcggggcatgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagagaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctc

SEQ ID NO: 3698 - DNA, 634 bp, Homo sapiens
ggagctgcgagccgcgaccgccgggagcgcacctgccccgcctccgccaggcggtccgcggggcatgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacctggagtgcagtggtgcaatcttggctcactgcaacctccgcctctcgggttcaagcgattctcctgcctcagcctcctga

SEQ ID NO: 3699 - DNA, 1378 bp, Homo sapiens
cactgggtggcgctgcccgctcggcccggcgctcctggagctgcgagccgcgaccgccgggagcgcacctgccccgcctccgccaggcggtccgcggggcatgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacgtggagtgcagtggcacaatcccagctcgctgcaacctccgcctcccgggttcaagtgattctcctgcctccgcctcccaagtagctgggattacagaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctca

SEQ ID NO: 3700 - DNA, 1181 bp, Homo sapiens
atgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaacaagtcacctgcaccggtgcccgtgacgtacgagctgcccacactgtataggacggaggactattttcctgtggacgccggggaagcacagcaccacccccgcacctgccctcggcctttgtgagctttgtggtcttcccatcaggaacgctggaaagtgacattgtgtacacactgcagcttgggggttttttctttgtattgctgtttattttatattttaaaaatatttaaaaaaatgtcgagatggggtctcactatgttgtccagactgatctcaaactcctgggctcaagtgatccacccaccttggccttccaaagtggtgggattatgggcaggagcctccgtgcccaggctgctgccattttcaaatttcctccctgcctcatgtgagaccacagggtttggagaagcagttggaacccacgtgtggtgatgcctcccacatcggcctgcttggggttctacaggggttgagggaccaggcctggccggggctgatggacagtggggactttccttctctccatgatggctttgcaggggctccatggtccttctctctgtgatgggtttttgcacggggtgtgctctgccactgtggtgggtgggtggatgctgcttctgttgcctccagacctcggtgcccacagccttgaggatccttccaataaaggtgtcaagagctca

SEQ ID NO: 3701 - DNA, 1450 bp, Homo sapiens
gctcgccgctggagaccgcgctcactatccgaggaggaccctcctctgccccgcgtccagctttagtccccgactgcgttcatcgccaagggcccgcccactgccttaggtcgcgtcgccagccttgggtcccgtcgccagccttgggtcccgtccccggctgcactcaccgcgaggccccacccttagctctagtccccggtgtcgcccaccgacgaggccccgccccaaactccagtcccgggctgcgctcaccgccgtggccccgcccccaagcgccagtcctcggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtagacagcctccgtcctgcatctttccccacctggggttgtgacctgggggttgtgaccagggttgtgaccggggtgtaccccaggtgcctccacgcatctcagtggccggtctgtgctgcctgcccagtcaggaagttttggtctgtaggatgaggggccttcatgacatgggggtcacagtccgagacttgtgggagtgtgggtctccatggcaggagggcacctgccaatgctgggcacggttgggtgttagctaggcctgggtgaacagtgaacttttgtcctacacaaaggagattattttcaattaaaaaatttttttgtgag

SEQ ID NO: 3702 - DNA, 2292 bp, Homo sapiens
acaaccgagtcctgcgcgccccgtgcgccgggggtcgctcccaggccgaggtctgacagtgtcgccgaacgcgaaaggaagcgtgtggtacccgagagaggaagcaccctcgtcaccccggccggcaccgcattgaggcaggtgtgcaggtgcggttgcggcgagccaggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcat

SEQ ID NO: 3703 - DNA, 1383 bp, Homo sapiens
cggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttag

SEQ ID NO: 3704 - DNA, 1086 bp, Homo sapiens
cggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtagacagcctccgtcctgcatctttccccacctggggttgtgacctgggggttgtgaccagggttgtgaccggggtgtaccccaggtgcccacgcatctcagtggccggtctgtgctgcctgcccagtcaggaagttttggtctgtaggatgaggggccttcatgacatgggggtcacagtccgagacttgtgggagtgtgggtctccatggcaggagcacctgccaatgctgggcacggttgggtgttag

SEQ ID NO: 3705 - DNA, 813 bp, Homo sapiens
ccgccaaggacacacccaccgaggccacagctgcgatttcatagtgtgggaccccactggcaaagacacgctggctgctgtggccgtggtttctgtcccagccgtctgtttccatagaaaaagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgc

SEQ ID NO: 3706 - DNA, 3314 bp, Homo sapiens
gcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaa

SEQ ID NO: 3707 - DNA, 3579 bp, Homo sapiens
gggaggtgcgtggcatggggcactggctttgctgatgaggagaccagacttcagaggccgtgtcacctggcctgggccgcacagctggtgcatgccaagctcgcgtgcagacgaagctccagaggcctggctgtcaggagggttcctccccgaggacacacacgcaacctcctggaccgccaggctttagacttttaaaacttccatatgcaggaaaccccacaggacgcagccagcatctcgggtcatgggtgcacctgtcaccgcagtcctgggctaaacagtgaacaggagctctgtgtctctgtggtcgttacagttgtagtgaatgttccctgggagagtcctcttcagaagatatttgcggtattttcaacaaaggactctccaggatggaggagcaactacaagtcaggaaggaaaaggctgacaacccagttttttaaaaaacgggcaaaggacgtgaacagacaccatgcaatggcccagagtgcacaaatcatcatttctcccaggaatggggtgcccgagcccccaggcggctgaacttgagacttgtcacgtagtgttggtggaatgcagagcagctggagatcacctgctgcaggtgggtgcgtaactccgcacggccaagccgtttggaaagctgtagcatatgcatgagagtccggaaagttccgagagaaagtgtgtggatgcacccgccaaggacacacccaccgaggccacagctgcgatttcatagtgtgggaccccactggcaaagacacgctggctgctgtggccgtggtttctgtcccagccgtctgtttccatagaaaaagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaa

SEQ ID NO: 3708 - DNA, 2368 bp, Homo sapiens
ggcgacgcctctaaatgagagacagcgccaaccaggtacccgcgaggacgaccccgccccgcaggacagggcatctccaccgcgcgctggacggaggatacaaccgagtcctgcgcgccccgtgcgccgggggtcgctcccaggccgaggtctgacagtgtcgccgaacgcgaaaggaagcgtgtggtacccgagagaggaagcaccctcgtcaccccggccggcaccgcattgaggcaggtgtgcaggtgcggttgcggcgagccaggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggcgcgaccttagcatgccccggtgtgcgaaggctaaaagccagccccacttccctgtgctcgcccagtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaa

SEQ ID NO: 3709 - DNA, 2858 bp, Homo sapiens
gtagaacatggcatagaagacggagctgccgacagccaagacgtactgggaggagaaagcgccgccgtgagcctggctctcccgcaggctgcgtgtcagccacacggcggacggggcggacggggcacgcgttccgagaggggccgccgctacccaccttgtgggcgggcaccgtcctggtcgcccccgggggccccacgacgaagtgcacgtcggccatgagctcgttgttgaacatgagcgcgttcctgcaaagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacag

SEQ ID NO: 3710 - DNA, 18259 bp, Homo sapiens
ggcgacgcctctaaatgagagacagcgccaaccaggtacccgcgaggacgaccccgccccgcaggacagggcatctccaccgcgcgctggacggaggatacaaccgagtcctgcgcgccccgtgcgccgggggtcgctcccaggccgaggtctgacagtgtcgccgaacgcgaaaggaagcgtgtggtacccgagagaggaagcaccctcgtcaccccggccggcaccgcattgaggcaggtgtgcaggtgcggttgcggcgagccaggtgagcgccgcccgggagccccaaggtcccgccgggtctgagcagcaccgggtcctcggaagctgagcgcggcccccggtgctcgggacctggggggctggggccgcgcttgccggagctgcgggggggcggcggctgcacgcgtcgaaccggcgggcgggggcgcggggggcgacctgggctccgctgggggacccgggccggggatggggcgcgcagaggccgcggccaggacacccccagcaggtgcccggcgggaacaaagcgcggcgggcggcgcgtacctgggcacgcagctggggctggagccgtccacctcccaggtggcgaacaggttcatgggcacgggcgtgttgagcgcgccgggcgcgccggggaggccgaggcggcctcgctcggccatggcgccggccccgccgctccctcggcggcctggggctgcggccgggccgcggacgcgcggcgggcgggccgggcgcgcggagggcggcggcgcggtcacatggctgccgggcggcggaggggacgggccgggccccggcgtcggacaggcccgcgggcggcgacgagctgcggccgctccgccccgccccgcccggcgccccgcccgcgccccgcgcgcccccggccgccccgcgcgcgcccggcgccctccgacccgcgccggcgccgccgattggctgggcggggcgccagctcgccgcctcgggtccaatcgccgccggcgcagcgcgcgccggaagtgaggtgcgcgcgcgcttcctccggcggcgcctcacggggcgtccccgcccgccggtgcgcgagagcgcgcactcacgcgcctgcgcacagaccccgcccggggcgccccgccccgccccccgggagccgcgggcaagggccgggagagtcgtgggggtccaccgggtcccggccagcttcaggcgccgccccctaaggaaagctcatcgtcgccctggcgatgcccacctccccacgcgcggattccccggcctcgacactttcccgcctccaccccgccatgccccgagtctccccgcccccctgccctcgccgccccttgtctcctgccgacccccgctgggttggcccggctgtgcgggccccgcccgtccccgagcccctccctcgcgcccccctgcgtgggttccccgggacgcagggaggtggcaaggaggtggccgggcctggcggcggtcgcggggactcgaagccactcggggcgccaggctgccgagcttagcctccagggctccagatgaccccgggcgccctctttgcgtcccagcatccttattcagcgccgcttttcagcgttgtgctcaggacaatggagaacaaatgtctggggccaaggctggctcctggccctggggttaacagtgaacttggggacccaagcaaagaggaggcaatggctagagccgctggggcccgacgtgtaggctctggggctcagggagggtgcttcccccatctgtttggcagcggctgtggtccagcaccagatgccaagccgagatttaggaaacggttttctggcctctcttctgtttccttgtttcacagttagtttacagttgcttttctcttcgccctgtgtcttgtctacaagtagttttactgaaacaaatccagcccgagcaaattgacctggagctggtttctttcctggcccacggggcttgccaccccagtgccccgtcagctccttctgcaaaggccctcatgccgctgcttcctccgttgagagagctcagcctccagctgtaactcctgtatctagaactgcaaacagctgcgactgcttaaagtcagggtcccacttcggagagaacaagggactctgtgtttcccacgcgcccctggctcctctaaggtggtacactgagagccatgagggtctgtctgaccttggccagctgctcggcgggcagagggccggtggatctcatacctttgagacagggtagggggagaagtgactatgtccagagagggggtagccataccccaggaggacaggctgtctgtgatgggagggcaggagacaggcacccattgaccccagaactgagcgtacggcgctgctggacctggcgagcgtgcagttgcagtcagacggatgggccgcctgacacatggtgcctgtgtatgccagcgtctaacccaggcagggactacaactgggggtcaagtgaggagatgcggggtgactaagccgtgcacagcagggcttggcaccagctgccaccattgagcggtgcccctcctctgtgccaggcaccgttgtgagcccttaagggacgtgacagttctgtcccatcccaagtgacaaaagaggagatggcggcctgtgaggttatgcagctgccaggggtcgggatatgacccacacagtctgtaccagagtggcccgaagaacccgtatggtgggtctacatcaatgcttctgccaggcaggaaagcagggacacgaaacacaccatgtgtcacgcctgcgaccacgtttatgtttgtttttaaggtgggatggtggtgatgggactgtggtcttctgtattttccaagtgcacagatgtcccttgggtgatcagagtaactttttagccagaacttgttatttgcactgccctcctctgtcggaaaatgatgctgtgctggtccttctcttgagggctgtgggtcacaggaggagatcccctgaaggctgggaggcatccctccccatgctatgaccctggcatggtgtgagccctcacccccgtgtttggagcacaggtgctttctctggtagcgttttctttaaagcaggaacttggtttgagacaaacctctcggatgactggggtggctgggcacggttggggaggaggtccaagaagaggatccttcagagccctggggtctcaggaggacaacctgaaagctggtcctaccacgtgctgcccggggtccccggaggttgtgggagttattattatttaagaagttaaagcttcaaggttctgaatgcttggctaggattccattggtattaaaaagacgaagccccaacccccagtcatgggacaggatgggccgaggcctttcctctgtccgcctggcttcgctaggtccctccacctagggtgaaggctcaggcttttccagtcgggcgccaggaccatgggctgcttggaaacgcattcatctcctcagcctgggctaagatgacacagacacacagcaggccctgctgaagtcggggagtgggggaggggcctcctccagggccagcactggtcagttggcggctccagcccacagcgcccctactccttctcctgccaggagctgggctgaggaagcagccccacgtggccaggtccctgcccagcccatgctatggcagagggacagaactgccgaacccctagacaggccctgccgcatccactcccatggttggagcacatggccatgactgaggctgaggaggaatggtcacaaaaaaggtacagcagggccctcctcctggaggcattttctgggaagccatgtgggggatggccaagagctctaagaccgctgagatcgctgcacccgcagccgcacctgtggacagttcccacggtcacccttagagcagctcaactgctgagagtgaggcctggaatcaaccccggggttgtagagtagaacagggttaggtgagccatgatagaacctgatagaatattctacagctggcagaaatagtgagttaaaagtagctaaaaacaggccagtcgcaggggctcacacctgtaatcccagcactttgggaggccaaagcgcacagatcccgtgacctcaggagttcaagaccagcttgggcaatatggcaaagtcccatctctaacaaaaatacaaaaacgtacctgggcatggtggtgcgcatctgtgatcccagtgacttgggaagctgaggtgggagaatcacttgaacccaggaggtggaggttgcagtgaaccaggatcacaccactgcactccagtctgggggacagagccaggctccatctcaaaaaataaaaataaaaaggccgggcacagtggctcatgcctgtaatcttagcactttgggaggccgaagtgggtggatcacctgaggtcaggagtttgtgaccatcctggccaacatagtgaaaccccatctctactaaaaatacaaaaaattagtggggcatgatggtgcgcgcctgtaatcccagctactcgggaggctgaggcaggagaatcgcttgaacccagcaggcagaggttccattgagccaagattgtgccactgcactccagcctgggtgacaagagtgaaactctgtctcaagaaaacaaaaatgtatgtgaaaatgcatgtccatgtgcagtatgtatttacatgttagtgattatacatataaaacacctattttcaggtatagaaaaatattgataggatacaaattaatccaaagtgttaagaaagtatctctgtgtgatggggattccattgatttggtttctcctttttgcttatctttatctcctattttctccatgatgaacatgtattaattgtgtagggaaaatcaaaccacagcagggtgagctgccgctggctggagagccgggcgccatctggctggggctgcgccccgtcctgaaaaaaccaaacgtgcaaagggaaccctcacccaacgcaacaaactattgaggatgatctttgtaagaatactgaatgtttcactagggtaacattcttttttttttttttttttttttgagacagagtctcgctctgtctgtcgcccaggctggagtgcagtggtgccatctcagctcactgcaagctctgcctcccgggttcatgccattctcctgcctcagcctcctgagtaggggggactacaggcgcctgccaccacgcctggctaattttttgtatttttattagagacggggtttcaccgtgttagccaggatggtcttgatctcctgacctcatgatccgcccgcctcgacctcccaaagtgctgggattacaggcgtgagccactgtgcctggctcactagggtaacattcttaatatcaaaggaaatcatacaagtccataagaccactaaaaaattcccagtggaaaatggttagagaagctacaaaagattcacaaaagaataagtgagacagttgtcactactatcacgaattgtaaattataaaaagatgcacatggctgggtgcggtggctcatacctgtaatcccagcactttgggaggccgaggcgggtggatctccaggtcaggagttcaaaactagcctgaccaatacactgaaaccccgtctctactaaaaatacaaaaattagtcgggtgtggtggcgggcgcctgtagtcccagctagtcgggaggctgagacaggagaattgcttgaatccaggaggcggagcttgcagtgagccgagattgtgccactgcactcctgcctgggcaagagagtgagactccgtctaaaaaaaaaaaaaaaaaaaaaaaaaaaagacacacatcaccaccttctccttaatgcaggctaatctagacctaatacagacctaaggtcgtgatgacatcctcggtgtcctgcacgctgctcccctcctgggttgggcgcaggcagcgcagctccctcacacagcacctggggcaggacccagagcagctctgcagagtggcttggcagcgtcttgggagatttgcctgggctcatgggtatcccatggcatcctgcaggtgacactggaaatgtcaacagggacacaggtccaggtgtgtgagatatttcaaacagcaacacctacagaaaggaatgtccagtccaggggaaatgacaaaacttgccctggcacatccaccccatgggatgtggaataaccagcaaaacggaacgctgcctcagttttagcaacatggggaaattctcagatatgtgattgtgtgacaaatcagggtgtaaagttgaacacagcatgacctggattcaggaataaaactctcccctcttgactgtggttatcctgagccccaagattaagagggaccttgatgcataaattttaacacttctttctttcccacaatagaatatcatcacaataagccaggacataacttaaatattagaaaagaaaggaaaacacccaggccctaatacagaaatcagccaaggacattcacagacatcagaacagcaattaccgcaacacgtgtcaaccaacactcaacctcagtgctcttcgtgcaggatggatttctggttttgttaggttttgtttgtctttttctttttttttcttttgttttcttgacagggtcttgctctgtcaaccaggctggagtgcagtggtgccatcatggctcactgtaggccagatctcctggactcaaaccatcctcctgcctcagcctctcaaagtgctgggattacaagtgtgaaccactgtgctgggtccctaagggttttaaaaaattatttatttatttagagacaaagtcatggctgggcacagtggctcatgcctgtaatcccagcactttggggggctgaggcaggcggatcatgaagtcaggagttccagaccagcctggccaacatggtgaaaccctgtctctactaaaactgcaaaacttagctgggcacagtggctcatacctgtaatcccagctactcagaaggctgaggcaggagaatcacttgaacccaggaggcggaggttgcagtgagccaagattgcaccactgcactccagcccggacgacagagcaagactccatctcaaaaaaaaaaaaaaaaaaagacagaatctgcctctgtcgtgcccaggctggagtacaatggtgccatctcagctcactgcaacttctgtctcctgggctcaggcaatcctccctcttcagcctcccgagtagctgggaccacaggcatgtaccaccacacctggctaatttttgtatttttgttagagatgctgttttgccatatttcccaggctggtctcaaacacctgggctcaatcaatcctctcacctcagcctcccaaagtgctgggataacaggtgtgagccactgtgcccggcctaattgtttttttgggggggacagagtctcactctatggtccaggctggagtgctgtggtgtgatcataactcactgcagcctcagtcacctgggttcaagcgattctcctgcctcagcctcccaagtagctgaactagaggcacgcaccaccacgcacagctaatttttaaattttttgtagagacagggatctcactttgttgcccaggctggtctcgaactcctgggctcaagctatcctcccacctctgcctcccaaagtgctgggatgacaggcgtgagccactgtcctggcctggcccttgacttctgtggtggaaggtggactggagcctcaccaagtctcactcgagttgcggagaacagacaggaacagggacttgccttctgagcagtctgtctaccagacacatgtcctccatcatactccgcagtgctagggtgggctattcttatccctgttatgcagatgaggaagtagaaacctagagagattgaagcacttgcccaaggccaggcagcaggtgagaaggtgagaaggccatagaagcttgctttctcatttcccctgctgactgctgcatggggggacagggctattgagtacccaggagttattttgatcaaatgtgataagatgacagacacagagacaaccgcctttgaaagaggagtttattactcacagttcccaggaggaggggcacgtggggaagcacccagggccagtcaggacagggagggggtgaagggaaagggtgggcaagagcctttattgccattttccaggcaaggcagaggaggcaagctgagcagaattagaactgggtcatttcagtgggctctgggcttgggggtggtatctagctagctggtacctggccttggggtgatttagggcagggggctagtgttcaggaatgcaggagcctgatgaaaggaggcaggtgggactcatgatggttgctctgcatatcaaaggtatgctcagcctgcacggtggctcaagcctgggatctcagtactttgggaggctggggccaaaggatctcttgagcccagcagtttgagacgacagtgagctatgatcataccactgcactccagcctgggtgacagagtgagaccctgcctcaaaaaaaaaagaaaaaaagaaaaaataaagtaaataaggcatactcagaggcaagtggtcagctgtctctaggaattagctaaccctgggaggggagtccctctctaggtccacgagaccccaagatgtcaaagcaccacagatgagaacacgatggggcttggcacggtggctcacgcctgtaatcccagcactttgggaggccaaggcagatggatcatttgaggtcaggaattcaagacgagcctggccaacatgatggaaccctgactctactaaaaatacaaaaattagctgggcgcagtggcaggtgcctgtaatcctagctacttgggaggctgaggcaggagaattgcttgaacccgggaggtagagattgcggtacatcaagatcgtgccattgcactacagcctgggcgacacagcgagactcagtctcaaaaaaaacccccaaaaaacaggccaggtgtggtggctcatgcctataatcccagcactttgggaggttgaggtgggcagatcacgaggtcaggagatcgaggccatcctggccaacatggtgaaaccccatctctactaaaaatacaaaaaattagccgggcatggtggcatgcacctgtaatcccagctaatcgggaggctgaggcaggagaatcgcttgaacctgggaggcagaggttgcactgagtcgagatggcgccgctgcactccagcctgggggacagagcaagactgtgtctcaaaaacaaaacaaaacaaaacaaaacaaaacaaacccaaaaacaaaagacaccatgaatgaagaaagcctccaggaggggaagtttgcaggtgcctaggcgtgtccttcaaaactctaaccctgctggtcaggtcatttttctcaggccctgagaaaaggaaatccttcctggtctaagtgttacgagcacgttcagttcagattaaagcaattctctcatttcagtgcaacacctacattactttccagctctctggggcccccatgaaggaatgttcctgccccacacccccagcctgggccccgctctgctgctgtgtgctggagtcaggtctaggggcaagcccacagcctctccctgtttacagccagagcggagatcactgcacgtttccagcgtcctctttggcgcggtgcgagtgagggtcctgccttgcagggctgaatgaggagtacagaggaccctgggcacaggaagctggtgctgggtgcccagtgtgggtgctctgagggcactggtgccccttggccgcccttgcttgactctttgagcttgtcagtcagtcctaaatgtttccaagcttcctggggcgcttgcagcatggggcacctaaccggtccccagggcagttctccgcattctccctctaacctggctccattctttatgccttcacatcacgtggggagcgttactccctgcctcagttggttcacactgcaatggcaaaccaccacagtccaagtggcttataaaccactattcatttcacaggacggtgctggcagatgccgtgtctggtgagggccacttcctggttcatagacagtgccctcttcctgcatcctcacatgggggaagcagcagacaagctccctccagccacgttttttcttttttcttgtttcttttttctttgagacaggttctcaatctgtcgcccaggctggagtggagtggtgtgatctcagctcactgcagcctcaactttctgggctcaagcaatcctcctacctcagcctcccaagtagctgggactacagacacatgctaccacaaccggctaagtttttgtagtttttgtagagtcagggttttgccatgttgcttaggctggtctcaaactcctggactcaagcaatcctccctcctcagcctcccaaagtgctgagatcacagatgtgagccactgtgcccagccagccacttttctgagggcattaatcccgctcatgagggaagcagccctcatgacctcatctcccaaaggccccacctctctaaaaccatcgccttggggcaaggacgtcaacatatggactttgggggaacacacatgatatgatttggctctgtgtacccacccagatctcatcttgaattcccacatattgtggagggacctggtgggagggaattgaatcatgggggcaggtctttcccgtgctgttcttgtgattgcgaataagtctcacgagatctgacggttttataagagggagtttccctgcagaagctctctctctccctgctgccatccacgtaagacgtgacttgctcctccttgccttcctccatgattgtgaggcctctgcagccacgtggaactacaggtccaataaacctcttttgtttgttaatcgcccagtctcacgtatgtctttatcagcagtgtgaaaacagactgatacaatgcacattcagaccatagcacccctcctctgcagcccatctgagcaaaggcttagttctggcagcacgcaccttgggccattgcccagtagagcctcacccttttttatattttattttattttattttatttattgtgagatggagtttcactcttgtcgtccaggctgaagtgcaatgacgccatctcgcctcaccacaactcccgcctcccaggttcaagcaattctcctgcctcagcctcccgagtagctggaactacaggcgcccaccatcacacctgctaatttttgtattttttggaaagatgggtttcaccatgttggccaggacggtcttgatctcttgacctcgtgatctgccctcctcagcctcccaaagtgctgggattacagtcctgagccaccgagcctggctgaaaccacaccctttaaacctcttaccgttgtgggtgtggtcttccccaccctctgctcctctggccaatcctgtcctgtacagcctgactgtcctgtactgcctgactgtcctgcaccgctgtggcctgggaggcatgctgccccttgcacctgcaggcacctcacaggctttggtgagggagcacacgaaataacccctctagtctgtcaggtgagagcaaggatccagtggccacatggcctcagattggattctggctttgttacctactggctatgagatttggggctgtcacccctcacatcctcaagggctccctccataaaatggagacaacagtgtctgcaagctagtgttgccataaggatgaaatgtcatcatggacagagagcattttgcatagagatcaataatacatatttgaaaaatccccaacatttagaaacaaaacaatacacttcctaataacccttggatccgggaggaaattaagagtggagacaatcttgagctgaatgaaaatgaaaacacagcacattgaaatgtgcaggattcagctaaagtggtaattacagggagaattatagcaataaaatgcctatttataaaggaaaagagatcttaaatcaatgatttcatctttcaccttaaaaaactaggaaaaggccaggcgcgatggctcacgcccatagtcccagcactttgggagggcgagacaggtggatcacgaggtcaggagatcaagaccatcctggctaacacagtgaaaccctgtctctactaaaaatacaaaaaattagccaggcatggtggtgggcacctgtagtcccagctacttgggaggctgaggcaggagaatggcatgaacccgggaggtggaggttacagtgagccaagatcgcaccactgcattccagcctgggtgacagagcgagactccacctcaaaaaacaaaacaaaacaaaaactagaaaaaggggccgggtgcattggctcacgtgtagaatctcaacactttgggagaccaagacaggtggatcacttgaggtcaggagtttgggaccagcctagccaacatggtgaaaccccatctctactaaaaatacaaaaattagctgggcgtggtggcacatgcctgtaattccagctacttgggaggctgaagtgacagaatcacttgaacctgggaggtggaagttgcagtgagctgagatggcaccactgaactccagcctgggtgttctctatctcaaaaaaaaaaaagaactagagaaagggcggggagcagtggctcatgcctgtaatcccagcactttgggaggacagggcggggagcagtggctcatgcctgtaatcccagcactttgggaagacaaggcgggtggctcacttgagcccaggagttccagaccagcctgggcaaatgaggcaaaaacccatctctacaaaaaatattatctgggtgtggtggcacatgcctgtagttccagctactcgggaggctgaggtgggaggatcacctgagcccaggaggtagagtctgcagtgaggcttgattatgctactgcactccaccttgggtgacagaatgagacactatctcaatttttaaaaaatgaagaaactagaaaaagggaacacattgaaccaaattaagtggaaagaaggatctaacaaaaatgagagcagaaattaatgaaatagggccatgcacggtggctcatgcctgtaatcccagcactttgggaggctgaagtgggcggatcacctgaggtcgggagttcaagactggcctgaccaacatggagaaaccccgtctctactaaaaatacaaaattagccaggtgtggtggtgcatacctgtaatcccagctactcgggaggctgagagaggagaatcgcttaaacccaggaggcagaggttgcagtgagccgatatctcaccactgcactccagcctgggcaacagagcagagactccgtctcaaaaaaaaaaaaaaaagaaagaaaaaaaagagggtggggtcttccgcatttccttttttctcttttttttttttgagacagagtttcactcttgtcacccgtcacccaggctggagtgcaatggcgggatctcagctcactgcaacctccacctctcaggttcaagtggttctcctgtctcagactcgcgagtagctgggattacaggcgcccaccaccaagcctggctaatttttttgtatttttagtggagacggggtttcgccatgttggccaggctggtctcgaactcctcaccttacgtgatccgcctgccttggcctcccaaagtgctgggattacaagcgtgagccactacgcctggttacgcatttctttttaggctcattcctgggtatgtcaccggccctatggcgattgtgaacagcacctgcagatatttgagggcgtgcgcagccagggttcccgctctgggcagggggcacagcgaggtgactcacgggtaaccacaggtggccacgaatgactgctagaaagtgggaattttaggggaacagaaaacggagaatagcggggcgcacggggaggctctggaacctgggcgagcggagcggcggacgccgcaaatgcggagggcggggcagggtggcccctggcgggtgtctccacctctgcggccaggccccccagcgcagctgccctggccccgcccaccactcccagagcccggggttgggtcccaggtcgccctcaggagccaaggccccgcccaccacgctcggccccctcgcctcaagccccgcccacagttcgggtccagacccaggctccgcccccttcccccgcccacagctccagttcccttcgcaggccgtctctccacgggaggccccgccccccaccctcagccccgcatccggctgagtcctcaccccaggcctcgctcgccgctggagaccgcgctcactatccgaggaggaccctcctctgccccgcgtccagctttagtccccgactgcgttcatcgccaagggcccgcccactgccttaggtcgcgtcgccagccttgggtcccgtcgccagccttgggtcccgtccccggctgcactcaccgcgaggccccacccttagctctagtccccggtgtcgcccaccgacgaggccccgccccaaactccagtcccgggctgcgctcaccgccgtggccccgcccccaagcgccagtcctcggctgcgctcaccggtaggccccgctcgggttccgccgaagcccagcccccgcaggtcgcccctccgacgccggcgcgccgcaagggaggccagctcgctcgcagtggggaggtcgcggctccagtcctcgcgtccccgccgtggtcccggtgcctgtcccatcccgcgggcgcggccgttgcgggcggcgcggcccgggcgcgcgcggcgaatctgcggctgcgaatcggctggagcggggcctcgcgagagcggcgaggcctgggcggctgggcctgggcgggcggcgcgggctgctccggaggctcgggtggcttgagagtcttgggaggctccgggcgctgcccgcgcggtcgccggcatgacgggccgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaa

SEQ ID NO: 3711 - DNA, 2876 bp, Homo sapiens
tttcttttcagggctagacattctgatggttgtgaaggaggagcttggggtggtttcatttgcatttccttcaggactggaggtctttgtatatgttcatttacaccaatatgtcgtcttcgccggagtgttcagatctttttccattttttaattgggttgtgttttcttgtgaagttttgggaattcttcatctgttctagatttaagtcctttatcagttacgagatttgcagataagcctgtgggctgtcttcattgtcttaacgatgtctttcaaagggcagttcttaattttttggaaatccgttttatcagtgttttatggattctgcttttagaaccattagaaatgtttgccttatccaaggtcacaaagtttttcttttacgtttttgtctgaaatgtctgtactttaactctccccctaggtctgtgatctgctttgagctaacttccgcgtgcagtgcgaggtgtgggctgaggctcgttctttggcacctgaccgccaggcaccgtgcactgacagccgttctatgggttacctggcagcttggtagcattgttttttgtcacaaaagcgggcaccctggccctctgcctggttaacaggtggattgtgtacacctaggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacag

SEQ ID NO: 3712 - DNA, 1970 bp, Homo sapiens
gcaccaccacgccctgcaaattttgtatttttagtaaagatggggtttctccatgttggtcaggccggtctcgaactgcggacctcaggtgatccgcccgcctcggcccccaaagtgctgggattagaggtgtgagccaccgcgcccagcctatgagcatattttttatcgttctctttatttctagctgcgatgattgtatcttattgaaaatcattaaaaatcttagcaattgttttaaattatctaatttttttctccaaataatatctattttagcagccaaatcaccacaaatcattggtttttatctttagttgtgggtgcacagcgggtgcgtgtattttggggcatgtgaggtgtcttgatgcgttcatgcagtgtgtaacagtcacatcagggtaaatgggacatctttcacctcaagcatttatccttcgtgttatggacaccctcagctggaaaggggggctgcgtcgtgagtatgaatggatgcaagtcatagccacctgagcctggtggggcacagcagggccctgtggagtcacatcccggcctcatgctcggcataggggagcgctgcttaggtccatgcagtcgctcagggcccaggctgtgcagcgcccagcctgtcctgctccaggcactcccccgtggcactgtgccgtgctggcagaggtgcacagcgccaggcctcagtgtgcacacacagcccccgtggcaccgccatgctggtagagatgccagaagtgggccctcctctcacccatgagtgtcagctgatgccggccggctggcgacttgtgtacccagcccacgcctgtcttgctctaagagtccccggaccgttgttgcgtgtggtgctgtctgcatggtctggagggaaggctgctgggtgtgcgcccctctgtgtcctgagcagggcggccatgcagtaggagcacgctgcctggccctagcgtgtctgcagcaggctggctggcagcaggtggccagtggctctcctgggttcggtgcgatggctgccctagctgagggtcagagaggctttgtccaggggaggggaactggtggggggcctgggggcctggaaagacaagtgcaggttgccccacccctgggctgcgtgggccgcctgtgcacgtgccatggcacatggaggtgggcactgaggtgctgtgtctgccgcagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccagtgagttc

SEQ ID NO: 3713 - DNA, 1040 bp, Homo sapiens
gcggccgcggcgctggcgggagcgtagagttccgccgccatcttcgcgggcggggcggcgggggcagcctcggcgcctgtggacgccgcgccccgcgccctcgcgccgcgccggggcctcgggagcggctctgcaagcaaaagcaaggaggtcaggcactgagcgacgcggccgtgcaggcaggctaggggcagcagcatgggcggcggcggcgctgtgacccgcggggctgccacccgctcccctgccacccccgcccctgcgaccctgcccgagcccagcctagcgcagcccggccaggcccggccgcggggggcgccgtcccgcccgcccgcccgcccgagcccgtacccgccgcggcgccggtgcgtcacgctgcgtcagggccgcgccccgcgcgacgtcgctgcctcgcggccccgcccccaggcccgacatcctcgaagctgctcgagcttctgcccagcaaccggcgcgagccgcgcgctgtgcagaggtagccgtggaaggcggctcccggcgctggcaggcggccgcccccagacccgcagtgccatgcgcaggtgcttgcgcccgttcttcagttagcgatcttttggttaggaacgcaggtggacctgcttgtttggccatttgcattccggagtctgcctctggccgcggcctgtgggatggtcgttgggcttcctcgttcgttcagatgcttcgcgatttagcttgctacggacgccagcagccagcgcttgcagagagcgcggtccactctgctctgagggctttacaggggcaggcgctgctatttcccggcattttcctcgaggaaataggcacagagagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtc

SEQ ID NO: 3714 - DNA, 1362 bp, Homo sapiens
acgctgcgtcagggccgcgccccgcgcgacgtcgctgcctcgcggccccgcccccaggcccgacatcctcgaagctgctcgagcttctgcccagcaaccggcgcgagccgcgcgctgtgcagaggtagccgtggaaggcggctcccggcgctggcaggcggccgcccccagacccgcagtgccatgcgcaggtgcttgcgcccgttcttcagttagcgatcttttggttaggaacgcaggtggacctgcttgtttggccatttgcattccggagtctgcctctggccgcggcctgtgggatggtcgttgggcttcctcgttcgttcagatgcttcgcgatttagcttgctacggacgccagcagccagcgcttgcagagagcgcggtccactctgctctgagggctttacaggggcaggcgctgctatttcccggcattttcctcgaggaaataggcacagagaggttagtcgcgcgctgaaggtcacacagccggcgggtgggcaagtcaggatctggccctgggcctgcagccctggagcttgggccccagggcgcgccctgcctctgtggctctgcctgtggatcgcagtcgcaggctcgctccttgtggggcctctagcctcccggcctggggctaatcctgggaggtgcgtggcatggggcactggctttgctgatgaggagaccagacttcagaggccgtgtcacctggcctgggccgcacagctggtgcatgccaagctcgcgtgcagacgaagctccagaggcctggctgtcaggagggttcctccccgaggacacacacgcaacctcctggaccgccaggctttagacttttaaaacttccatatgcaggaaaccccacaggacgcagccagcatctcgggtcatgggtgcacctgtcaccgcagtcctgggctaaacagtgaacaggagctctgtgtctctgtggtcgttacagttgtagtgaatgttccctgggagagtcctcttcagaagatatttgcggtattttcaacaaaggactctccaggatggaggagcaactacaagtcaggaaggaaaaggctgacaacccagttttttaaaaaacgggcaaaggacgtgaacagacaccatgcaatggcccagagtgcacaaatcatcatttctcccaggaatggggtgcccgagcccccaggcggctgaacttgagacttgtcacgtagtgttggtggaatgcagagcagctggagatcacctgctgcagacccgtgcctgtatattccacgctttgcgcacctgctggaattcggggagaagaaccacgaggtgtccatgactgccctgaggctcctacagaggatgaagcgggactgg

SEQ ID NO: 3715 - DNA, 778 bp, Homo sapiens
atagaagacggagctgccgacagccaagacgtactgggaggagaaagcgccgccgtgagcctggctctcccgcaggctgcgtgtcagccacacggcggacggggcggacggggcacgcgttccgagaggggccgccgctacccaccttgtgggcgggcaccgtcctggtcgcccccgggggccccacgacgaagtgcacgtcggccatgagctcgttgttgaacatgagcgcgttcctgcaaagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgt

SEQ ID NO: 3716 - DNA, 2603 bp, Homo sapiens
tggccggaagacgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcggctccacggagctggtggaagactcgcactattcgcagagccagctggtgtgctccgactgcggctgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgatggatatccactgggagcacttcatcctgttctgacagcttgataacattcctgttataaccaaggatggaagtgtacaccagtccgtaggtattgcttttcttgtttgaaggaaccaagaggggctctgccattagttggaccctgggtcctggagtaaagtcaggagtgcagggatgactataggtaggagagattcccatcccttggtgtgggagagcaagttgcctatgtccatgttctgtgagatggctttcctcatagatggatgggaaaatgtcaggctctttgctgctggtttgaattggacacactgctgcggctcctcctgcaggcctgagggggcttccctctgcttgtggagtggttggcattcccagcagtatcaaccctcagaggagcgggaactggggaattctggccctacgtgcattcacaggcaatgatgggtttgtgtgtatggtgtcatgagatcctctacctcataacaaaaggacagtgggtagactaaggcagtagctcaaagggctttgcaaaattttaatatattaaaacaagaggcatctgctagaaaacattctattgtataaaacccgagttcttaaaaacatgttttctttggcactttcattccctccctcccctttccccagcatattgcaaaaagctctccagtgctaaggcattggcagggtgtgtaaacagcagccagcatatgtggaagaataatacaaagcttttttttttcttctaatatgtctgtgcagcaagcataaataacaggacccattccaaggagtgtgtgtgggttttccccctcccctgtgtcctctgtcaccttggtgatgaggccagagtgatgtgaagactgggagggaaccctaggtcagaccttggtttcctgttgttcttcccaagacccagggttccctcggtttccatttggtcctgtagtgaaatgctggtggttggttttaggttggggaaaagacgggtgctggtgtttaaaaggagtaaaggcataggcccctcatgacctgcagggaccccagccactgcctctgggcttggcttgagctcctgggagtcgggaagctggtttgacattttgtaggtttctctctactgtggagctggagatcaaatgattgggatggttcttcctctggccttacggaggcaaggaagtgctcttccttagtcccgtggtgttgtaaggctg

SEQ ID NO: 3717 - DNA, 1410 bp, Homo sapiens
ctcccagcggagggaaccgcctatgcctccgtcgcgctggccggaagacgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcgtggtcaccgagggggtccttaccactaccttcagcgacgagggcaatctccgagaggtaacatattcccgaagcacaggggaaaacgaacaagttagtcgcagccagcaacgaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcagcttcaaactgttccaagcttcaccttctgtgccagccaaatacgtggaagacaaagagaagatgctgtctcgaacaatgcagttggtggagctggcaaatgagacgtggctggtgaccgggaggcatcccttgcccgtcatcactgctgcgactttcctggcttggcagtcgctgcagcctgcagatcggctttcatgttcccttgcccgattttgtaaattggcaaatgtggacctgccctacccggcgtcctcccgcctgcaggagctgctggctgtgctgctgcggatggctgagcagctggcctggttacgagttctgagacttgacaaacggtctgtggtgaagcacatcggtgaccttctccagcaccgccagtcactggtccgctctgcctttcgggatgggacagcagaagtggagacccgagagaaggagccaccggggtggggacaggggcaaggagaaggggaggtgggaaataattccttaggtttaccccaggggaagcggccggccagtcctgcccttctcttgccaccctgcatgttgaagtccccgaagcggatctgccctgtaccccctgtctccactgtcactggagatgagaacatttctgatagtgaaatagaacagtatttgcgtacccctcaggaagttagggactttcagagagcccaggctgctagacaggctgccacgagtgtccctaaccctccctgatggatatccactgggagcacttcatcctgttctgacagcttgataacattcctgttataac

SEQ ID NO: 3718 - DNA, 2210 bp, Homo sapiens
agaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctaactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgact

SEQ ID NO: 3719 - DNA, 2124 bp, Homo sapiens
cgggggcctcagaaaaccacagggcgcggggccagggcggcggcccccagggagttggcaggatggcagagggcaaggcaggcggcgcggccggcctcttcgccaagcaggtgcagaagaagtttagcagggcccaggagaaggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatgggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctaactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactcagggaatatttaattctggttttagcattattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgact

SEQ ID NO: 3720 - DNA, 1990 bp, Homo sapiens
ctgtttctctctttcaagcccggctcgggtgtcctgcctgctttctgcactctatccctaccagttccaggcttagagcctacctggagcaagaaacgcagtgtacatggcggcttcgcatgcatactcagagaacctaaacgtgttttcgatatggtgctgcagaaattggggaaagctgtagaaaccaaagatgaacgatttgaacaaagcgctagcaacttctaccaacaacaggcagaaggccacaagctgtacaaggacctgaagaacttccttagtgcagtcaaagtgatgcatgaaagttcaaaaagagtgtcagaaaccctgcaggagatctacagcagcgagtgggacggtcatgaggagctgaaggccatcgtatggaataatgatctcctttgggaagactacgaggagaaactggctgaccaggctgtaaggaccatggaaatctatgttgcccagttcagtgaaattaaggagagaattgccaagcggggtcggaaactcgtggactatgacagtgcccgacaccacctggaggcagtgcagaatgccaagaagaaagatgaggccaagactgccaaggcagaggaagagttcaacaaagcccagactgtgtttgaagatctgaaccaagaactactagaggagctgcctattctttataatagtcgtattggctgctatgtgaccatcttccaaaacatttccaacttgagggatgtcttctacagggaaatgagcaagctgaaccacaatctctacgaggtgatgagcaaactggagaagcaacattccaataaagtctttgtggtgaagggactgtcaagcagcagcaggcgctctttagtcatttctcccccagttcgaacagctacagtctccagtcctcttacctcacctactagtccctctacactttccttgaagagtgagagtgaatctgtctcagcaactgaagatctggcacctgatgcagcccaaggggaagacaattctgagatcaaggagctcttagaagaggaggaaatagagaaggaaggatctgaagcaagctcctctgaggaagatgagcctctaccagcctgcaatggccccgcccaggcccagccctctcctaccactgaaagggccaagtcccaggaggaagttctccccagctccacaactccatcaccaggcggagccctgagcccttcagggcagccttcatcatctgccacagaagtagtcctccgaacccgcaccgcaagtgaaggatctgaacaaccaaagaagagagcctctatccagaggacctcagcaccccctagtaggcctcctccacccagagccactgcaagccccaggccctcctcagggaacataccttccagccctacagcctctggagggggttcacccaccagccctagggcctccttggggactgggactgcaagtcctaggacctccctagaggtctctcctaatccagaaccaccagagaagccagtaagaactcctgaggccaaagaaaatgaaaacatccacaatcagaaccctgaagaactttgtacttcccccaccttaatgacatctcaggttgcttcagagcctggagaggcaaagaagatggaagacaaggaaaaggataataagcttatctcagctaactcctcggagggccaagaccagcttcaagtctccatggtaccagaaaacaacaacctcacagcacctgaacctcaagaagaggtatccacaagtgaaaatccacaactctgaagagaaactaccaagactcctcctgccccaaacctcgccagagaagctcttcaaccagagggtataggtcagagggatataagagccagcatccatccctgggttctcagtaggaatgctggtgctgtctaaagacctggcattaatggaggcggaggagcagccttacgggagggatggagggaggcaggctggggagaagagaacattagactca

SEQ ID NO: 3721 - DNA, 1835 bp, Homo sapiens
aatccggaagtgaccctagagaaacgagttgtggctgaggaccccggcggcagacgcaggttcgggaccatgagctggattccttttaagattgggcagcccaagaaacagattgtgcccaaaacagtggagagagactttgaaagggagtatggaaaacttcagcagctggaagagcagacccggaggctgcagaaagacatgaagaagagcaccgacgcagacctggccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtccacatagtattgtgctgtaacttaggcgagcagaggaaaccccttcctgggcctgctgccctccacggagcagcagcaccctccagcaggcagcccagcatgccaggggtgtgtgcgcacctccccggccctggcccaccttctggagcgaactgcaccgtggtccagcagaggcgctgggtgggagggcacgcgggcaagcctaggagagtaggaagagctgtggaggacacactctcagtttgtttttgactttggtttatttaaaaaacaagccaaaaaaaaaaaaaaaaaa

SEQ ID NO: 3722 - DNA, 1431 bp, Homo sapiens
aagtgaccctagagaaacgagttgtggctgaggaccccggcggcagacgcaggttcgggaccatgagctggattccttttaagattgggcagcccaagaaacagattgtgcccaaaacaccatgtcaaaatctgccgtgaagatatccttggacttactctccaatcccctctgtgagcaagaccaggaccttctgaacatggtgacggccctggacacggccatgaagcggatggatgccttcaatcaggaaaaggtgaaccagatccagaagactgtgatcgagcccttaaaaaagttcggcagtgtcttcccgagcctcaacatggctgtgaagaggcgggaacaggccttgcaggactacaggaggctgcaggccaaggtggagaagtatgaggaaaaggagaagacggggccagtgctggccaagctccaccaggcacgagaggagctgcggcctgtgcgggaggactttgaagccaagaacaggcagctgctggaggagatgccgcgcttctacggcagccgcctcgactacttccagcccagctttgagtccctcatccgagctcaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccctctggcccctcgttgccttttcacttcaaaacctcttttttctgggagaggccctgaaccctgtgcgggagagctggtcctccagccctggcaggccctcagccagcttcccagcaagacaaagggcacccttgtggctttgggacctaagtggttggggttcccgaggtcactgaggactggtacctcgggaacgcaagctgtcagtggaactgtcccacaagaattcacaggtctcaaagcaggaacagtgggtttgtgtctcacctgagtatctggaattttattttttcaagtaaaattttcaatgaaacgtcc

SEQ ID NO: 3723 - DNA, 4526 bp, Homo sapiens
cagcccggccggggcctgcgggcgcccagagccgcgccgtccgcgccgcccgttctggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcatcagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcagaaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggagagctgatgatgagcctcctgtggtattacagacctgagcacttacagggaggccgcagtcccagcatgcacgagcccttgcagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttagaaaaggatcgttt

SEQ ID NO: 3724 - DNA, 4698 bp, Homo sapiens
tttctcgagaacctactgtgtgcatatcccgggcttagtgaagtcctaggcgggctctggcaccaccaggtgcccaagacacagctccttcccgcacctaacagggacttcccatctctctctgtgcccttagcctgctgtgcccacccaccccactgaccccgcgagcgtgctcgggcttgggagggcacgtctgtgggggtgagagacggagccacagcatttggtgactagggggaagccaggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccattggttcctgagaagcccaaggcctgcaaagtgctgctgactcgcctggagaatgtggccggtccccggagtgcagatgaggctgatgagctaccgcctgacctgcccaagccccccagcccggccccatccagtgaagaccctggccttgcccagccccgcaagcggcgcctggcctccctcaatgctgaagctctcaataacctgctgctggagcgagaggacaccagcagcctggcaggcacccgccgcagtcgagcaggggatccccaccgcagccgtgaccgtgatcgtgctactgggggctggtcctcctccaagaagcggccccggctgggggaccttggaggaggaagtcgggacctgtctccagagccagcacccgatgaaggtccccgccgagatggagacccagctcccaagagactggctagcctgaacgcagctgctttcctaaaactgagccaggagcgggagctacccctgcggctgcctcgtgcccatgcagaagtagatgggcgctccactgagcccccagcacccaaggccccgaggccaaagtggcccaaggtcaatggcaagaactatcccaaggcttggcagggggccagctctggggaggctgcaggcccacctggctggcaaggctgccctgatgaaccatggccatctgcaactccttgtgggccatccgtccagccatctcatcagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggctgcagatccctgggccagttggaatttcctctcccggaagctggccacccagcctcacccgcccacccactcctggggtgccctgtacccagtgtgccacctgcagcagagcccgtcccccatcttcagacacccacctcggagccccagacagtagcccgtgcgtgccctcagagcgccaaacctcccagcggttctaagtcaggtctgcgcacaggctccagctgcaggcacactgcaaggagcaaggctgcccgcaggcctagccaccccaagcagccacgtgtccagcgcccacgccctcgccgccgccgtcgccgccgcactaatggctgggtacctgttggggctgcgtgtgagaaggctgtgtatgtcttggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggagagctgatgatgagcctcctgtggtattacagacctgagcacttacagggaggccgcagtcccagcatgcacgagcccttgcagaatgaagtgtttgcatcgcgacatcaggaccagaacagtgtggcctgcattgaggagaagtgctatgtgctgacttttgccgagtactgcaggttctgtgccatggccaagcgccgaggtgaaggcctccccagccgaaagacagcactggttcccccctctgcagactattccaccccaccccaccgcacagtgccagaggacacggaccctgagctggtgttcctttgccgccatgtctatgacttccgccacgggcgcatccttaagaacccccagtagcctcctcatgcccatgctggggctacccatgggcaagtggggctcggggtagggggcactgcttgaagcacagcacttggttagggggccacagaggcctaagtttgctggcctgtggttttcttgggggggagggcaggggcccctgtgggttctgggctccaggggagggagctggggaggccagggtataagaaaagcatcagaactctcagcttggcccaaggtaccttctgtggttcccctgggtggagatttccgaaaagtagtcttctctgaggctgggccaagcctgagggaaatggggccctaggagggtgggggcgggaaggaggggcaaggtctttcaggaaccagacccaacaggcccttctgtagcctcccccttgccctcaaagggggagtgggggccagctttacctcacccactgtgacccgccgcttccccttcagcctgggaccaggctttcctagatcccagcacagctctgagcttgttcctttgaggcatagagagccagagtctggcttccagagcattgacttcctcttcctagacttgaggccttttctctggctttcctcctttgccctgcagtagcaactggtgctgggacaagttgacccacctctcacagtcatgggtgtggcccacttgtgggagtctcctgtccacctcccagagacggccacccagcgggtctggcttcccagaaagttaactgatgattgtggggtttgtcatatctgggagggaagatgggtgctgggagagggttgggggcagggggcaaggaaaattgctacctgatttgttgaagatttttcctcttgccttacacatggaggttccaggaaacctcttgcagaacttcacacgtgattcttcaagccacacccacctgaaatcaaaccaaaggagtgctgtggctccccttgccctgccaccctttccctagtcttttgtagattgcactaatttacatcctagcaagaatcaacactgtatcagtccacggacctgctgagctgcagccacttgctctaggagctaaggacttgcattttcagtttgttcctgttgcccagaggccctgttctcacctcatgctgctccccagagtagactaacaggctcagtcccctgttgtccttgtggagactaggccttggccctggccctgagactctgtgagggggctggagcagcctggttatttcctatctgtaccaaagaggagtatggtgggagagggagtggagtgcagtgtggcttgggcctggtgctgggaacctgctagctgagcacttccacaagggcatacccctgggggcaggggctggggctgagaactgcagccctgggtcttcccttagggaggaagggcagatgaacccagcaggcttaggaggtggcactgggtgaggacagctgggcaggggctgcagagggaggtggaaatgaaccctgagggctcccccaacttgccatgccctgtcccttagtagatgagttgctcctgattggtcattgggtttgggtgaggcctggaggcttcagaggtgaatttatgcttgggaagcctgatcccaaacctgaagggaagggacttggatctccttatattgaataagctgtttggaggaaggtgtctgtctgggaggatggggcagtaaatgaggttggcagagtggcagtgggggctctgcagagccagccttggagcctgctcattctgggcccttgctgccaaggagcccagcctcacctagcaggaaaggagatgaaggccctcctcccaggaggtagggtcttggctgccccgaacttaaatgcttttgaaatctcttagatgtggaaatattttttcgaacctgaaaatgcagctggtagaatttcaatggaagcataatccatgtaaaatatattttagttgatattttgtaaaatgcactttttgtgtgtgttgatcctggtttcccagatctgtatttcagtgtttacaagggaggaaggacctttcctcacctcccttttgacagagattagaagtacttctttaagaaaaaaataaatttgagaaattgtattgatttag

SEQ ID NO: 3725 - DNA, 5920 bp, Homo sapiens
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaaggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttcaaataa

SEQ ID NO: 3726 - DNA, 6010 bp, Homo sapiens
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttc

SEQ ID NO: 3727 - DNA, 5775 bp, Homo sapiens
cccgcactgccccccgcggcggggcgtcctgccccattgtgaggcggcggcaggacgagaggaggtagggcgcgctcggggggcaggggcggcggcggctccgctcgctcgacacccgggcagcggcaggaacgaactcggctccggtagcggccgcggcgcgtcagtcacacaaaaggcagccgagcttctcccagcgcgcggaccggcccacgctgccgccgagggctccccaccttaccggctttcctttccctccaattttgatagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaagatttaacagaggctttggatgaagatgcagaccccacaaaatctgcactgtctgcagttgcatctttggcagctgcatggccacagttacaccagggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttcatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataaagcaataacaattgattgaccacatgaaagtgtggcctgcactatattctcaattttaatattaagcactcaggagaatgtaggaaagatatcctttgctacagttttgttcagtatctaataagtttgatagatgtattggatacagtactggtttacagaggtttttgtacatttttgagatcattcatgtgtccagagatcttggaaaatattttttcacccacgatttattttgttattgatgatttttttttaaagtggtggtattaagggagagttatctacatggatgagtcttccgctatagcacagtttagaaaaggtgtttatgtcttaattaattgtttgagtacattctttcaacactacacatgaatgaatccaatcttataaccttgaagtgctgtaccagtgctggctgcaggtattaagtccaagtttattaactagatatttatttagtattgagagtaatttgtgaatttgttttgtatttataaaatttatacctgaaaaatgttccttaatgttttaaaccttttactgtgtttttattcctctaacttccttaatgatcaatcaaaaaaagtaacaccctccctttttcctgacagttctttcagctttacagaactgtattataagtttctatgtataactttttaactgtacaaataaaataacattttttcaaata

SEQ ID NO: 3728 - DNA, 5218 bp, Homo sapiens
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgaggagtgaaaagctcctcccaacagctcttcctccttcagagccgaaagtagatcagaaacttcccaggagctccgagaggcggggaagtggcggtgggacgcaattccccgcgcggagtcgggcagtggcagcgggagaagcggcagccaggggcgcggcggggccggagagaggcggtcccctgggaggacggggtctcccctcgttgcctttgtagtggagaaggtggacaagtggcagtcggcgtgatcgcagggaagcggggccggcgcgggcggccgagggtccaggcgagcccgcgggcggacgggagatgccgctgctacaccgaaagccgtttgtgagacagaagccgcccgcggacctgcggcccgacgaggaagttttctactgtaaagtcaccaacgagatcttccgccactacgatgacttttttgaacgaaccattctgtgcaacagccttgtgtggagttgtgctgtgacgggtagacctggactgacgtatcaggaagcacttgagtcagaaaaaaaagcaagacagaatcttcagagttttccagaaccactaattattccagttttatacttgaccagccttacccatcgttcgcgcttacatgaaatttgtgatgatatctttgcatatgtcaaggatcgatattttgtcgaagaaactgtggaagtcattaggaacaatggtgcaaggttgcagtgtaggattttggaagtcctccctccatcacatcaaaatggttttgctaatggacatgttaacagtgtggatggagaaactattatcatcagtgatagtgatgattcagaaacacaaagctgttcttttcaaaatgggaagaaaaaagatgcaattgatcccttactattcaagtataaagtgcaacccactaaaaaagaattacatgagtctgctattgttaaagcaacacaaatcagccggagaaaacacctattttctcgtgataaactaaagctttttctgaagcaacactgtgaaccacaagatggagtcattaaaataaaggcatcatctctttcaacgtataaaatagcagaacaagatttttcttatttcttccctgatgatccacccacatttatcttcagtcctgctaacagacgaagagggagacctcccaaacgaatacatattagtcaagaggacaatgttgctaataaacagactcttgcaagttataggagcaaagctactaaagaaagagataaacttttgaaacaagaagaaatgaagtcactggcttttgaaaaggctaaattaaaaagagaaaaagcagatgccctagaagcgaagaaaaaagaaaaagaagataaagagaaaaagagggaagaattgaaaaaaattgttgaagaagagagactaaagaaaaaagaagaaaaagagaggcttaaagtagaaagagaaaaggaaagagagaagttacgtgaagaaaagcgaaagtatgtggaatacttaaaacagtggagtaaacctagagaagatatggaatgtgatgaccttaaggaacttccagaaccaacaccagtgaaaactagactacctcctgaaatctttggtgatgctctgatggttttggagttccttaatgcatttggggaactttttgatcttcaagatgagtttcctgatggagtaaccctagaagtattagaggaagctcttgtaggaaatgacagtgaaggcccactgtgtgaattgctttttttcttcctgactgcaatcttccaggcaatagctgaagaagaagaggaagtagccaaagagcaactaactgatgctgacaccaaaggctgcagtttgaaaagtttggatcttgatagctgcactctttcagaaatcctcagactgcacatcttagcttcaggtgctgatgtaacatcagcaaatgcaaagtatagatatcaaaaacgaggaggatttgatgctacagatgatgcttgtatggagcttcgtttgagcaatcccagtctagtgaagaaactgtcaagcacctcagtgtatgatttgacaccaggagaaaaaatgaagatactccatgctctctgtggaaagctactgaccctagtttcaactagggattttattgaagattatgttgatatattacgacaggcaaagcaggagttccgggaattaaaagcagaacaacatcgaaaagagagggaagaagcagctgccagaattcgtaaaaggaaggaagaaaaacttaaggagcaagaacaaaaaatgaaagagaaacaagaaaaactgaaagaagatgagcaaagaaattcaacggcagatatatctattggggaggaagaaagggaagattttgatactagcattgagagcaaagacacagagcaaaaggaattagatcaagatatggtcactgaagatgaagatgacccaggatcacataaaagaggcagaagggggaaaagaggacaaaatggatttaaagaatttacaaggcaagaacagatcaactgtgtaacaagagagcctcttactgctgatgaggaagaagcattaaaacaggaacaccaacgaaaagagaaagagctcttagaaaaaatccaaagtgccatagcctgtaccaatatctttcccttgggtcgcgaccgcatgtatagacgatactggattttcccttctattcctggactctttattgaagaggattattctggtcttactgaagacatgctgttgcctagaccttcatcatttcagaataatgtacagtctcaagatcctcaggtatccactaaaactggagagcctttgatgtctgaatctacctccaacattgaccaaggtccacgtgaccattctgtgcagctgccaaaaccagtgcataagccaaatcggtggtgcttttacagttcttgtgaacagctagaccagcttattgaagctcttaattctagaggacatagagaaagtgccttaaaagaaactttgttacaagagaaaagcagaatatgtgcacagctagcccgtttttctgaagagaaatttcatttttcagacaaacctcagcctgatagcaaaccaacatatagtcggggaagatcttccaatgcatatgatccatctcagatgtgtgcagaaaagcaacttgaactaaggctgagagattttcttttagatattgaagatagaatctaccaaggaacattaggagccatcaaggttacagatcgacatatctggagatcagcattagaaagtggacggtatgagctgttaagtgaggaaaacaaggaaaatgggataattaaaactgtgaatgaagacgtagaagagatggaaattgatgaacaaacaaaggtcatagtaaaagacagacttttggggataaaaacagaaactccaagtactgtatcaacaaatgcaagtacaccacaatcagtgagcagtgtggttcattatctggcaatggcactctttcaaatagagcagggcattgagcggcgttttctgaaagctccacttgatgccagtgacagtgggcgttcttataaaacagttctggaccgttggagagagtctctcctttcttctgctagtctatcccaagtttttcttcacctatccaccttggatcgtagcgtgatatggtctaaatctatactgaatgcgcgttgcaagatatgtcgaaagaaaggcgatgctgaaaacatggttctttgtgatggctgtgataggggtcatcatacctactgtgttcgaccaaagctcaagactgtgcctgaaggagactggttttgtccagaatgtcgaccaaagcaacgttctagaagactctcctctagacagagaccatccttggaaagtgatgaagatgtggaagacagtatgggaggtgaggatgatgaagttgatggcgatgaagaagaaggtcaaagtgaggaggaagagtatgaggtagaacaagatgaagatgactctcaagaagaggaagaagtcagcctacccaaacgaggaagaccacaagttagattgccagttaaaacaagagggaaacttagctcttctttctcaagtcgtggccaacaacaagaacctggaagatacccttcaaggagtcagcagagcacacccaaaacaactgtttcttctaaaactggtagaagcctaagaaagataaactctgctcctcctacagaaacaaaatctttaagaattgccagtcgttctactcgccacagtcatggcccactgcaagcagatgtatttgtggaattgcttagtcctcgtagaaaacgcagaggcaggaaaagtgctaataatacaccagaaaatagtcccaacttccctaacttcagagtcattgccacaaagtcaagtgaacagtcaagatctgtaaatattgcttcaaaactttctctccaagagagtgaatccaaaagaagatgcagaaaaagacaatctccagagccatcgcctgtgacactgggtcgaaggagttctggccgacagggaggagttcatgaattgtctgcttttgaacaacttgttgtagaattggtacgacatgatgacagctggccttttttgaaacttgtttctaaaatccaggtcccagactactatgacatcatcaaaaagcccattgccttaaatataattcgtgaaaaagtgaataagtgtgaatataaattagcatctgagtttattgatgacattgagttaatgttttcgaactgctttgaatacaaccctcgtaacacaagtgaagcaaaagctggaactaggcttcaagcattttttatattcaggctcaaaagcttggactccacgtcacacccagtaatgtggaccaagttagcacaccaccggctgcgaaaaagtcacgaatctgactttgtccttctaaaggatatatttgaagaaaaacaaattgttcatgaaaatggaacattaaatcatgctgtataa

SEQ ID NO: 3729 - DNA, 6102 bp, Homo sapiens
cgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccaaaaaataaaaaaaccacaaaaaacaaaaaaacaaaactaaggcacttcacttagagactggagtcctgcttataatcatgcatataacctttactttgatggatctggccagaggggtgttggagcccagcccacccacataccagtcaagctcttaggggagcagaagaaaagcaggaagaatttaaatgtttaattttttttttaaattgacttttctagttattaaaagttgcttgtttcagcagtgatattgtataaagaacatcttgtaagatactcctgacatcttgctttagcacatgtacagtacagtttctatgataatgtgtttgctctaacttccctggcttctccttcagcccatccactctcctctagagcagttgggttggaggctcattgaggcaagcagcaacattggagggggagcagggcagtgctgtgtctgctgcctcccatgcccgttctgacctcagccttggaactcctcaagaacctgaagattccagtggtcagtgtcggtggggggtgggaggagagagcggcagagaagctctgagagccccttcccccacaacaaatctagctctagttgttatatttaggcaaaactttgtagtcttctttcccttttatgatggattttgataaaagtacaaaacagggtttttcttttttatcacctttgaatttggaaattttgagcacccaagctcttctgtacctatttaaagtccaccaaggggactgcagctcctagaacatgagaatcaagcctcttaattttaaactgcggaatgtggcctctgcttcctccgtcctcctgcccaaggacgacgaggattgctccagggctgctgggtagtttaccgtcccttctataggcatggagttggcactgacatcacagcttcataaccccaccaccgccagcttcccctgcctcctacatccagtctgttcttgttcatagtgagaatcctgtgttcccacttcagtgacacctgaattgtttgttgttgttttttttttttattgtcttcaaagaggaagggccccattaaagggtgaacttgtaataaattggaatttcaaataaacctcatgtacttgtgtttataaagaagaaaccactctg

SEQ ID NO: 3730 - DNA, 5428 bp, Homo sapiens
cgggcccgggggaggaggggaatctcccgccatttttcaataatttcctccggtgctgctgaggaggagtcgtgactgccggccgccgggacccgaagcggaggtcggcggggggctgctgggaggcgcggcggtgtgcgcgggagctctgcgccgtggcgttccgctccatgactgtcgcgcggccgcgccggcggtgagggagccggagttcgcgccgccctctcacccctcccttcccccaccccacccccgggcgcctggcgctcgctccgggccgcggggcctagtgctgcgccgcggggccggccccagcagccgccagtccccaccgccgccgccgcgatggcgccgctcctgggccgcaagcccttcccgctggtgaagccgttgcccggagaggagccgctcttcaccatcccgcacactcaggaggccttccgcacccgggaagagtatgaagcccgcttggaaaggtacagtgagcgcatttggacgtgcaagagtactggaagcagtcagctaacacacaaggaagcctgggaggaagaacaggaagttgctgagcttttgaaggaggagtttcctgcctggtatgagaagcttgttctggaaatggttcaccataacacagcctccttagagaagttagtagatactgcttggttggagatcatgaccaaatatgctgtgggagaagagtgtgacttcgaggttgggaaggagaaaatgctcaaggtgaagattgtgaagattcatcctttggagaaagtggatgaagaggccactgagaagaaatctgatggtgcctgtgattctccatcaagtgacaaagagaactccagtcagattgctcaggaccatcagaagaaggagacagttgtgaaagaggatgaaggaaggagagagagtattaatgacagagcacgtagatcgccacgaaaacttcctacttcattaaaaaaaggagaaaggaaatgggctcctccaaaatttctgcctcacaaatatgatgtgaaactacaaaatgaagataagatcatcagtaacgtgccagcagacagcttgattcgtacagagcgcccaccaaataaggagatagttcgatactttatacggcataatgcattacgagctggtactggtgaaaatgcaccttgggtcgtagaagatgaattggtgaagaaatactctctgcccagcaagttcagtgactttttacttgatccatacaagtatatgactctcaacccttctactaagaggaagaatactggatccccagacaggaagccctcaaagaaatccaagacagacaactcttctcttagttcaccactaaatcctaagttatggtgtcacgtacacttgaagaagtcattgagtggctcgccactcaaagtgaagaactcaaagaattccaaatctcctgaagaacatctagaagaaatgatgaagatgatgtcgcccaataagctgcacactaactttcacattcctaaaaaaggcccacctgccaagaaaccagggaagcacagtgacaagcctttgaaggcaaagggcagaagcaaaggcatcctgaatggacagaaatccacagggaattccaaatctcccaaaaaaggactgaagactcctaaaaccaaaatgaagcagatgactttgttggatatggccaaaggcacgcagaagatgacacgagccccacggaattctgggggtacacctaggacctctagtaaacctcataaacatctgcctcctgcagccctacacctcattgcatactacaaagaaaacaaagacagggaggacaagaggagcgccctgtcctgtgttatctccaaaacagctcgtcttctctctagtgaagatagagctcgtctcccagaagaattgcgaagtcttgttcaaaaacgctatgaacttctagagcacaaaaagaggtgggcttctatgtctgaagaacaacggaaagaatatttgaaaaagaaacgggaggagctgaaaaagaagttgaaggaaaaagccaaagaacgaagagagaaagaaatgcttgagagattagaaaaacagaagcggtatgaggaccaagagttaactggcaaaaaccttccagcattcagattggtggatacccctgaagggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactatggtgaattgggaatgaagctgtcggaaatccccttgactctgcattctgtttcagagctggtgcggctctgcttgcgcagatctgatgttcaggaggaaagcgagggctcagacacagatgacaataaagattcagctgcatttgaggataatgaggtacaagatgagttcctagaaaagctggagacctctgaattttttgagctgacgtcagaggagaagctacagatcttgacagcactgtgccaccggatcctcatgacatactcagtgcaagaccacatggagaccagacagcagatgtctgcagagttgtggaaggaacggcttgctgtgttgaaggaagaaaatgataagaagagagcagagaaacagaaacggaaagaaatggaagccaaaaataaagaaaatggaaaagttgagaatgggttaggcaaaactgataggaaaaaagaaattgtgaagtttgagccccaagtagatacagaagctgaagacatgattagtgctgtgaagagcagaaggttgcttgccattcaagctaagaaggaacgggaaatccaggaaagagaaatgaaagtgaaactggaacgccaagctgaagaagaacgaatacggaagcacaaagcagctgctgagaaagctttccaggaagggattgccaaggccaaactagtcatgcgcaggactcctattggcacagatcgaaaccataatagatactggctcttctcagatgaagttccaggattattcattgaaaaaggctgggtacatgacagcattgactaccgattcaaccatcactgcaaagaccacacagtctctggtgatgaggattactgtcctcgcagtaagaaagcaaacttaggtaaaaatgcaagcatgaacacacaacatggaacagcaacagaagttgctgtagagacaaccacacccaaacaaggacagaacctatggtttttatgtgatagtcaaaaggagctggatgagttgctaaactgtcttcaccctcagggaataagagaaagtcaacttaaagagagactagagaagaggtaccaggacattattcactctattcatctagcacggaagccaaatttgggtctaaaatcttgtgatggcaaccaggagcttttaaacttccttcgtagtgatctcattgaagttgcaacaaggttacaaaaaggaggacttggatatgtggaagaaacatcagaatttgaagcccgggtcatttcattagagaaattgaaggattttggtgagtgtgtgattgcccttcaggccagtgtcataaagaaatttctccaaggcttcatggctcccaagcaaaagagaagaaaactccaaagtgaagattcagcaaaaactgaggaagtggatgaagagaagaaaatggtagaggaagcaaaggttgcatctgcactggagaaatggaagacagcaatccgggaagctcagactttctccaggatgcacgtgctgcttgggatgcttgatgcctgtatcaagtgggatatgtccgcagaaaatgctaggtgcaaagtttgtcgaaagaaaggtgaggatgacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatgaagaggaggaggaggaagaagaggaggaggaggaagaagattatgaggtggctggtttgcgattgagacctcgaaagaccatccggggcaagcacagcgtcatcccccctgcagcaaggtcaggccggcgcccgggtaagaagccacactctaccaggaggtctcagcccaaggcaccacctgtggatgatgctgaggtggatgagctggtgcttcagaccaagcggagctcccggaggcaaagcctggagctgcagaagtgtgaagagatcctccacaagatcgtgaagtaccgcttcagctggcccttcagggagcctgtgaccagagatgaggccgaggactactatgatgtgatcacgcaccccatggactttcagacagtgcagaacaaatgttcctgtgggagctaccgctctgtgcaggagtttcttactgacatgaagcaagtgtttaccaatgctgaggtttacaactgccgtggcagccatgtgctaagctgcatggtgaagacagaacagtgtctagtggctctgttgcataaacaccttcctggccacccatatgtccgcaggaagcgcaagaagtttcctgataggcttgctgaagatgaaggggacagtgagccagaggccgttggacagtccaggggacgaagacagaagaagtagagaggcagggccgtggtaagggagctgaggtggggggacagctagggagggtgggagggaggcgagcgaggaagaccaagaacctggaagagatcacagggagtccagaaacgcctgtcatcccaagcttatgctgtttttctaaaagctctttatggggcttgatattgggttggtggtctttgtccagaaatatgaagggacaaagagggccataaccctcccttctgagagtttccaggaggagtccgagggtctagcttttctggtgaagccagttcctgttcctgccttctttcctaagggcctgctcgctctggcttccaccacagtgccaagcccctctggtctccaggggagggattgctgtgttacatagcaggatcggggtaatcaggccaacaggggagatggtggcgatttttcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttct

SEQ ID NO: 3731 - DNA, 8844 bp, Homo sapiens
agtctgtcacacagggacatcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagac

SEQ ID NO: 3732 - DNA, 2773 bp, Homo sapiens
gtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataa

SEQ ID NO: 3733 - DNA, 8600 bp, Homo sapiens
agtctgtcacacagggacatcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagaga

SEQ ID NO: 3734 - DNA, 7845 bp, Homo sapiens
acttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcaggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 3735 - DNA, 8043 bp, Homo sapiens
acttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 3736 - DNA, 8058 bp, Homo sapiens
gaagccttgttggttgacgtcacttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 3737 - DNA, 8289 bp, Homo sapiens
tcccttggctcctttaggagctgataggtcatttattattggaactgaaatggtataaacaattctctctctttttttcccttgttaacagcaactttcattgttagagagaggagagagagagaagccttgttggttgacgtcacttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 3738 - DNA, 640 bp, Homo sapiens
ccggcttgggcctctagctctcccgtgtgtagctggaggctctgagtttactgaagatgagcgggggtgggggtggggcaggtgggattgggaaaagatctggatacctgggaaggtctatgtcagcacgcagaaggtttgaggagcattgcttctcatacagtaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctccccc

SEQ ID NO: 3739 - DNA, 1912 bp, Homo sapiens
acttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccaaggaagatgatgaagaagaagatgagg

SEQ ID NO: 3740 - DNA, 4710 bp, Homo sapiens
cgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaa

SEQ ID NO: 3741 - DNA, 4736 bp, Homo sapiens
gacgccgtcgccgccgctgctgccgccgccgctgccacagcctttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtaaccgaattggacgaagtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaactgtcaatttagaattc

SEQ ID NO: 3742 - DNA, 860 bp, Homo sapiens
ttgccgccacggtctccgccgccgctgtcctcgcgctgcctctgggagcctccattgttccagcagcgcccggtcccgagaccgggcatcttgggggctcgcgaaacgggcggcggccgacggagttgagaccccagggcgccggcgggaccaggagcggcaggggtcagctcaggaatcccggggagccgggaccaaagcgtggggcggcagggggccggggtggcgaggtctacggtctccggagttggggctcccccttcccggcccgactttccccgccgacctccccaagtggggtcggagccccggcgggcgcccccggcgatgagcccggactcgaggtggccgtacatctcctacccagtaccagggccaggctccccataaagacctcaaaagtaaatgaattctttctgtgatccagtgatttctgcaggagtccaacgctaaagcattagccacccacccattcagctttctacatggccttcatcccatctgagctctcagtctggtgatcccctcattcagctattcgttcaacagatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggagg

SEQ ID NO: 3743 - DNA, 534 bp, Homo sapiens
agatgcagccgccattctccttgggccctccccacgggctttctggtctaagttctcgtctccctcgcctgtgcctctgctgccgggttccaaggggagattgctgattcgctgtgctactttgggaaccattcacccgggacccagcttggaaagaggagagcttgtttgtgcttcggttggtttatgtttaaagacacagccgcagatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggcc

SEQ ID NO: 3744 - DNA, 4308 bp, Homo sapiens
gatgtgacagcatgggggtggactttgatgtgaagactttctgccacaacttgcgggcgactaagccaccatacgagtgcccggtggagacctgccgaaaggtctacaagagttacagtggtattgagtaccacctgtaccactatgaccacgacaacccaccacccccacaacaaactccactccgcaagcacaagaaaaaggggcgccagtcacgcccagccaacaagcagtcacccagcccctcagaggtctcacagtcaccaggccgtgaggtgatgagctatgcacaggcccagcgcatggtggaggtggacttgcatggccgcgtccaccgcatcagcatctttgacaacctggatgtggtgtcagaggatgaggaagcccccgaggaggcccctgagaatggcagcaacaaggagaacactgagacaccagctgctactcccaagtcaggcaaacataagaacaaggagaagcgcaaggactccaaccatcaccaccaccacaatgtttctgcgagcaccactcccaagctgccagaggtggtctatcgggagctggaacaggacacccctgatgccccaccccggccaacttcctattaccggtacatcgagaagtctgcagaggagctggacgaggaagtagagtatgacatggacgaggaggactacatctggctggatatcatgaatgagcgtcggaagacagagggtgtaagtcccatcccgcaggagatctttgagtacctaatggaccgactggagaaggagtcgtactttgagagtcataataaaggcgaccctaatgcgctagtggacgaggatgctgtttgctgtatctgcaatgatggtgagtgccagaacagcaatgtcatcctcttctgtgacatgtgcaacctggccgtgcaccaggagtgctacggtgtcccctatatccctgagggccagtggctgtgccgccgttgcctgcagtcaccctctcgtgctgtggattgtgccctgtgccccaacaagggcggtgccttcaagcagacagatgacgggcgctgggcccatgtggtgtgtgccttgtggatccctgaggtctgcttcgccaacacggtcttcctagagcctattgacagcattgagcacatcccaccagctcgctggaagctcacctgctacatttgcaaacaacggggctcaggggcctgcatccagtgccacaaggccaactgttacacagctttccatgtgacatgcgcccagcaggctggcctttacatgaagatggagcctgtgcgggagacaggcgccaacggcacctctttcagtgtccgcaagacagcctactgcgacatccacacgcctccaggttcagcacgccgactgcctgccctgtcccacagcgagggtgaggaggatgaagatgaggaggaggatgagggtaagggctggagctcagagaaagtcaagaaggccaaggccaagtcccggatcaaaatgaagaaggcacggaagatcctggcagagaagcgggcagcagcacctgtggtgtcagtgccctgcatcccaccacacaggcttagtaaaatcaccaaccgcctgaccatccaaaggaagagccagttcatgcagaggctgcacagctactggacactgaagcggcagtcacggaatggggtcccattgctacgtcgcctgcagacacacctgcaatctcagaggaactgtgaccaagttgggagagattctgaggataagaactgggcccttaaagaacagctcaagtcctggcagcggctccggcatgacttggagcgagctcggctgctcgtggaattgatccgcaagcgggaaaaactcaaaagggagacgatcaaggttcagcagattgccatggagatgcagctgactcctttcctcatcctccttcgcaaaaccttggagcagctccaagagaaggacacaggcaacatcttcagcgagccggtccctctgtctgaggtacctgactacctagaccacatcaaaaagcccatggactttttcaccatgaagcagaacttggaggcttaccgctacctgaattttgatgattttgaggaggacttcaacctcatcgtcagcaactgcctcaagtataacgccaaggacaccatcttctaccgggcagcagtgcggcttcgtgagcagggtggtgctgtgctccgccaggcccggcgccaggcagaaaaaatgggcattgactttgagacgggcatgcatatcccccacagcctggctggagatgaggccacacaccacactgaagatgcagccgaggaagagcggctggtcttgctggagaaccagaagcacctgccagtggaagaacagctaaagctgcttctggagcggctggacgaagtgaatgccagcaagcagagtgtgggccgctcacggcgtgcaaagatgatcaagaaagagatgacggcactgcggcggaagcttgcccatcagcgagagacgggacgtgatggccctgagcggcatggcccctcgagccggggtagtctgacaccccacccggcagcctgtgacaaggatgggcagacagatagtgcggcagaggagagcagcagccaggagacaagcaaaggcctgggtcccaacatgtcctcaacccccgcacatgaggtgggcaggagaacctcagttctgttctccaaaaagaacccgaagacagctggaccgcccaagaggccgggccggccccccaaaaaccgggagagccagatgacccccagccacggaggcagtcctgtggggcccccccagctccccatcatgagttccctgcgtcagcgcaagcggggtaggagcccccggcccagttcgagctcagacagcgacagtgataagtccacagaagaccccccaatggacttaccagccaatggcttcagcggtggaaaccaaccagtgaagaagagtttcttggtataccgtaatgactgcagccttccccggagcagctcagactctgagtccagcagcagtagcagtagcagcgctgcttcagaccggaccagcacaacgccctcaaaacaaggccggggcaaaccctccttctctcggggcactttcccagaggacagcagtgaggatacctcaggcactgagaatgaggcctactccgtgggcactggccgcggcgtgggccacagcatggtaaggaagagtctgggccggggagctggctggctgtcagaggatgaggactccccgctggatgctctggacctcgtgtgggccaaatgccgaggctatccatcatacccagctctgatcattgatccaaagatgccccgagaaggtatgttccaccatggggttcccatccctgtgcccccactggaggtgctgaaacttggggagcagatgacccaggaagcccgagagcatctctacctcgtcctcttctttgacaacaaacgaacctggcagtggctgcccaggaccaagctggttcctctgggtgtgaaccaggacctagacaaggagaagatgctggagggccgcaagtccaacatccgcaagtcagtacagatcgcctaccacagggctctgcagcaccgcagcaaggtgcaaggcgagcagagcagtgagaccagcgatagtgattgatactgctcaacacagcccaacctatagtgccctgtgacttctctcctcccctttgctcactgtcctggagtggcaccggcctctgcactgactcatttctggtcttggggccagtctcaggggaagctgggtgggggaggtccctcctgccctaagtgcagctggactgtacagaacactccaagggccaatggcagttcagcgcaaggagagggagggcccacaggtcagaaaaagctccagagacctcacagcattgtagggcggggtggtgggccaaagttaggacactgcgtaaaacaggccatcccaccacctctacctgctcatgccaggagaatccataactgcctagaggcctggggcccctaccggtcgtgaggtgagtgggcatctgtccagcctggaagaggggcactaggtgactccctcccctgctgttgtaaatactgtaattatcggagaatttaaattattctcatttgtaactgcgtttccgggtcgcgccagagtcatttggtactaaaaaaaaaaaaaaaaaagactgggggctgtccccatttcccttctctttcccatagattcccccacctttcaaactggtttgtatttatttcaaaggaagaaaatatattgattcttagaaaataaa

SEQ ID NO: 3745 - DNA, 11381 bp, Homo sapiens
ctctccttcctcctccgcctcctcagctcttgggctagaatatctatgggtcgaaacgtgatgcgatgaattcgagagagagcgaaactaggacgaggagtgcggcggaagcggcgggactcccgggcatgggggcttcaccacaatagaggcagcgcccccacccgcccccgccagcccctccggagcgaagcccccaaaccccctcgggaaaaggatggcggcagcacctacccagatcgaagccgagctgtattacctgatcgctaggttcttgcagtctggaccctgcaacaaatccgctcaggtgctagtgcaggagctcgaggagcatcagctgattccgcgccgcttagattgggaggggaaagagcaccgaagaagcttcgaggatctggtggcagcaaatgcacacattcctccagactacctccttaaaatttgtgagagaattggtcctttactagataaagagatccctcagagtgttcctggggtacagacattattaggtgttggtcggcagtctctgctacgggatgccaaagactgtaagagtacactatggaatgggtctgcttttgcggctctgcatagaggcagacctccagaactacctgtaaattatgtgaaacctccaaatgtggtgaatatcacctctgccaggcaattaaccggctgtagtcgctttggtcatattttcccttcatctgcttaccagcacattaagatgcataagagaattctggggcacttgtcatctgtctactgtgtagcatttgaccgaagcgggagaagaatttttacaggttcagatgactgtttagtaaaaatttgggctacagatgatggacgccttcttgctacacttcgtggacactctgctgaaatttctgacatggctgttaactatgaaaacactcttattgctgcaggcagctgtgataaggtagtaagagtatggtgtcttcgaacttgtgcacccgttgcagtccttcagggccattcagcttctattacttccatacagttttgtccatcaactaaaggcacaaacagatacctcacttctactggtgctgatggaacaatctgtttctggcaatggcatgtaaaaacaatgaagtttagagatcgcccggtgaaatttactgagagatccagacctggagtccagatatcttgttcatctttcagttctggtggtatgttcattacaactggtagtactgaccatgtgattagaatatattatttgggttctgaggttcctgagaaaattgctgaattagagtcacatacggataaagttgttgctgttcagttctgtaacaatggagacagtttaagatttgttagtggaagtcgagatggaacggcaagaatttggcagtatcagcaacaagaatggaagagtatagtgctagacatggctactaaaatgactggcaataatttgccatctggagaagacaagatcactaaacttaaggtgactatggtggcctgggatcgctatgataccacagttattactgcagtgaacaattttcttttgaaagtgtggaattctatcacaggacagcttcttcatacattatctggacatgatgatgaagtattcgttctagaagcccatccatttgatcaaaggatcatactttcagcaggtcatgatgggaacatttttatttgggaccttgaccgggggaccaaaattcggaattactttaacatgattgaaggccaaggccatggtgcggtgtttgattgtaaattttcaccagatggaaaccattttgcctgcacagattctcatggacatttgctgctttttggttttggatgcagtaaatactacgaaaagattccagatcagatgttcttccacacggattatcgtcctcttattcgtgatgccaataactatgtattggatgaacaaacccaacaagctcctcacctcatgcctcctccatttttggtggatgttgatggaaatcctcatcccacaaaattccaacggttggtaccaggacgggaaaattgtaaagatgaacagcttataccacagctgggatatgtggctaatggtgatggtgaggtagtagaacaggtaattgggcagcaaaccaatgaccaagatgagagcattcttgatggaataatcagggagctgcagagagaacaagacctgagactaattaatgaaggagatgttccacatttaccagttaatagagcatactctgttaatggtgctctgagaagtccaaacatggacatatcttcttccccaaacatcaggcttcgaagacatagtagtcaaattgaaggtgttagacaaatgcataacaatgctcctcggagccagatggccactgaaagagatctcatggcgtggagcagaagagtggtggtcaatgaactaaataatggggttagtagggtacaggaagaatgtcgaactgcaaaaggtgacatagaaatcagtctttatacagttgaaaagaagaaaaagccatcttacactactcaaaggaatgattatgagcctagctgtgggcgttctttacgcaggacacagcgcaaacgtcagcatacttaccaaacacggtccaacatagagcataattcacaggcatcatgtcaaaattcaggtgtacaggaagactcagacagttcttcagaggaagatgaaactgttggcacaagtgacgcttcggtagaggatcctgttgttgaatggcaaagtgaaagttcttccagtgactcatcaagtgaatattctgattggacagcagatgctggaataaatttacaacccccaaaaagacaaaccagacagacaacacgtaaaatatgcagcagctctgatgaggaaaatttgaagtccctagaagaaaggcagaagaaacctaagcagactagaaagaagaaaggaggactggtttctatagcaggtgagcctaatgaagaatggtttgcccctcagtggatcttggatactataccccgacgttccccatttgtcccacaaatgggagatgagcttatctattttaggcaaggacatgaagcttatgttcgggctgtaaggaaatcgaaaatatacagtgttaatttacaaaaacagccatggaacaaaatggatctcagggagcaagagtttgttaagattgtaggaatcaaatatgaggttggcccacccacactgtgctgcttgaagcttgcatttctggacccaatttcaggcaaaatgactggagaatctttttccattaagtatcatgacatgccggatgtcattgacttccttgtgctacatcagttttataatgaagccaaagaaaggaactggcagattggtgatagattccgcagtataatagatgacgcctggtggtttgggactgtggagagtcagcagccttttcaaccagagtatcctgatagttctttccagtgttacagtgttcactgggacaataatgagagagaaaagatgagcccatgggatatggagccaattccagaaggaactgcctttccagatgaagttggtgctggtgttcctgtctcccaggaagaattgactgctttgctatacaaaccccaggaaggagagtggggggctcattccagagacgaagaatgtgaacgggttattcagggcatcaaccaccttctttccctggattttgccagcccttttgctgttccagtggatctcagtgcctaccccttgtattgtactgtagttgcttatccaactgacctcaataccatcaggcggagacttgaaaatcgcttttacaggagaatatcagcattaatgtgggaggtacgctatattgaacataatgccaggactttcaatgagccagacagtcctatagttaaagcagctaaaattgtaactgatgtcttacttcgatttattggggatcagagctgtactgatatactggatacttataataaaattaaagcagaagaacgaaacagtactgatgcagaggaggatacagaaattgttgatttagattcagacggtcctggtacttcatctggaagaaaggtcaaatgccgaggcagaagacagtctttaaagtgtaatcctgatgcttggaaaaaacaatgcaaggaactattgagcctcatttatgaacgtgaagactcggagccatttcgacagccagctgatcttctttcttacccaggtcatcaggagcaagagggagaatcctcagagtctgttgttccagaaagacaacaagattcatctctttctgaggattatcaagatgttatagatactcctgtggacttcagcactgtgaaagaaactttggaagcaggaaactatggtagtcctctggaattttataaggatgttcgccaaatattcaacaactccaaagcttatacctctaataaaaagtcaaggatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctagtccaaaagggaagcagaaacaaatgaagttgcagcctaaaaatgaccagaatacctcagtatctcatgccaggactagctctcctttctcatctcctgtttcagatgctgctgaagggctttcactatatctacttgatgatgagccagatgggccattttcttcatcgagcttcggtggatatagccgaagtggaaatagccatgacccagggaaagccaaatcatttcggaatagagttttgccagttaaacaagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaacagttaataaatttagaataacttaaaaaattcaatggccttctactgcagggaatttaccaggaaatctacaaagcaagttgtgtggggacttctgcttcctttcacattggtgcttttccatttatgccagtatacatttgtttcaagacttttgatctccacacttcatttgttcaaataagccttactcattaggccttaaattaaaagaaattctgcccacacacacacaaacacatacacacacatacacacacacagacacacacacacgaaacacaacacagacactacagatttactacattaaaggagcattcagcttcttaagagtagcatgacatttttatctcaatagaatagccctcttttgcttttgtatcacagaagtatagcaccttcttacagagttttatatagtttgtttttgccattttgattcctatacccagtaataataacttttgcacaatacaccaatcctaaaggcagctattaaatgtttacagtttctatattgtaagagcgatctggattattttactcttcccaggccaaactttcatgacttgtactgaactgaagtatatatttatactacagttttttggggggtggggggatcttgatatgcttttcattgatttgcataattcacgttaaaggtgagaaagggttggtgccttgtaaatatgtagcagatcttcgtggtgtgttctgatgtgtgcattaactttattaaaaaagaatacttgaggtatcaatctagacaaggtgccaaatgcaaaagtttcccgcatcaatttttttcctatcacattttattgcattaatagaatttgtgtagcttaaataacttaaacatttgaaaaatcctcatccacaaagaacaacttctttgaacagtagctcagctacctcttaactacaactactggaaacattaaggaaaatagatgctgttattccttactgactaaggagaaatagaacaagcttagtaggaatgaataccccataagttataagctgagaggttgttaataattgtattggctctcaaattaataattgtaattaacaaagtttcataaatatagtatgctctaccaccttaggctttcttagaacatatttgtgtaagtagacttgggctactgcttatatatttctgctccacttaccatttaacagctgtgagttgctggttttcatttgaatcttaaaatttaacaaagcacctggtttgatttggaatgttttggctagctagtattatgaatcaacttatagattctgctcatatcattccaaagggttcttctgttctagtctttcaggaaagaaccttattgcactgcacactcatgttgtgaatcattattttatagataaaaaacatctttaaaaacccttattgtcttgtttacagcagtagagtgcacatggttccataagtgagcttgagttccaaggtcagttttactccccaaatttaatattacagatttgttcatttgttagatacttacatttctgaggtaagagggataatagcaatttctgtttctgtaacagcaaatttgttgcacttagatcaggctcatgggataaaacagacttcttagtatatacctagctatcccaggatatttcttaagctaatgtgtttgtctcatgctttcaatcatttcatgcatctgaaaacccttaagtgcagaggaaggcgtacacacataaaactttgcttttttggtagggtcggcagtagggttattcttggactaacatctttaagcagttttcacttgcagtggaaatgatgttcaggctttaagagaaagtattgtgaattgttaatggcactaacttctgttactagacagcagaccaagctatttttttgttgtagtctttttttcactaaaccaaaactacttctggttgtaactcagctgccactttaaaccatagtagagattcaaaacgttcctatttgaaactacatttgatttttgctaaaatgtgctgtttcggttatttatctcttgggcatttagactaaattgtgcctgtattcctgaaatcaataatactttggcttatcctgatctaagtaacatagttacttaaattcctggatatacccaaatatggatcacatgtatcattttagtttgaaattttttgttgacattcttctatgaagagctgacctcttgaaatgtagaagaattgacatttgtgtgattttggctatctggagctttatttataatttattttgaaaaataaaaatgccacatttatttcccaaatgtcaagattttctagaattagataattagaataataaggctgaagacattttaaagcatattttatatgtagtgaaatactgtgaaaatattagtgaacagcattttgctgtaatgtttatttcagttattaagatttaaagagttagtcatcagggtatgttagataaacatagttatcatttattaaacaaacagataattttctgtttgcatgcaaattattttaataagtgtgaaaataaaagtttggaagatagtatttttacttttatatctggacttttttttcccccaatttacactttgctttcttgtaataccacctcctgtgaatgtgttgtaattagtatcacattgattactttatcattttaatttctttgaggccctttaaacctacgtaaaatctgggtccagccatagcaaagcaagtacaaaatgaacaaagaattttgaagaaaagcctaaatcttaaattgctaagaaaaaacactgttatatttaggcccgtgagagcatatacatgtataaacctaatcctatgctagatatgaatagtcagtgagctgtaatatttctcataaatgctaataatgtttaaattcccagctttaagatcttagtgtgtgtatatatttataaaatctgaattgtgtgtttcttctatggcttactgtgtgtttctctttcagcaataggatgctctctaaaacattcactagcctactagcctacttactaaatttttgtatatgtgtgtttgtgcacttgtatgtgtgtaaagttttttccccaacttgacacaccttatctcagacattcaaaaaaagagaacattttgtatggaggacagtctgccaactttttgcctctctacagctcttagcctgtatatttactgcttgatcattcattatgccttctagataaccagtccaggttttgtcatatacctgtgtccctctattctttttatttccctttttaattttttttcttttttttccctccccagaaatcaggcttgtgttggaattcttctctataatactttgtttcccgcagatgcaaagtaacaaagtaactgagtaaaattagaaatctcattctgcacaactgtgcgctcagatatttaactcagccttctaatacttttaagtacgtttctgttatttatctttttgttgtttttgttttaatcccatagattgtcatcagacaataatagagtgattgagagagaaagatataaatgccacttctaactttttgataaaacttttttgagcatttttcaaaaatttgtatgtttgtggtaatggggaattaaacaccttttacagctgatgtatgttggaaatcattttatgtacatttaccaactggtacttatcttcaagttggaattttcacatccataaaagggagacttgcatcatatataattttcagtatactttgctgtccagccttttaaacaattacagtaacattttgagttctgtgatgaatagttctaggggaagggatggaactttcgacatgtaaagtccattgttttaaatgctaaccccatccccaatatttttgtggaacgtgaggctttatgaaaggtttatcagaaatagaatattctaaagtcacttttatggcttatttcaaaaactagtgtgaaagtattttcatgcttttttgtttctcatcttttagcaaagcttctttaccaagttttgattaaattgcaatataaaattaagttttttcacggtgctatattttgtggaatatgggtagcactcaggtttctttcttttttcttttctccttccttcttccttcattccttcattcctccctcccccctccctccctccctctcttccttccctccttccttccttcctcacctcggcctcccaaagtgctgggattacaggcatgagccaccgtgcccggcctatatacccttattcttgattatttcttttttcatcttttcaatcctgcttacttttatcctcacttttctttctgccatgaaaactgcacctaatttaccacacttaagattggcaatttttgattcattgatgggagaagtacagtagaaaggccctgcagtttagaattaagttgtgtttgtttatttacatgtatgcccatttcttctaaattaaatctagaatgtgagactttgacatataaaagcatgataagtattttcttaaaaaataagactattgatacataatgaaaccaccattggtaattgaattttaaaatgatatgcaaaaatatttagaaatccagttgggaaatgtgtttttgcatatgtcaccagatacacattaggcagtactacaaatgttaattcttaaacaatactgtggtgatggcaatcagtaatttatttctttgtcctgtaacttatcattcttgtcttttgtaatgtcttacacagtattaacataactgtaccttttttttgttcttggtatccatacattttaagatggaaaatcagttcatagttgatatgatattgtatatgggcaaaatgtccgttaaactaaaattcagtaaaaaaggtaatataaactggcttgatttataaaagatgttttgtttggcagttatcagtcattataagcaattatcttcaaagacaaaaaaactggactaatttgttgccattctttatgggatgtttacaataaaattccaagttgtttggaatcaattgcactcttgctgctttatgccttaatttatgtaccagagaaaaattaaccagaagaaagaaatatggagttacctattcagctttagagattgtaacatgtaactcttaggtctttcttgtttctttgtcatagaatattttattactattactttttaatctgagaaactaggatgcttcttcctatcaaagaaaaggttttgttttttgttttcatcttagacattgcaaatattctttgggtcacttttaggataataaatatgatgtttacactttaaatgtgggctgcttggtgcattcaataacagcctgcaaagcatttgtcaacattttgttttgcagagcttttcaaaatgaatagatctctaacatatttatgacttacaacttttaacagctgagttatatgtacctgacattttaaaatgtatagtaagattacctacattgtaaatggtgctttaattcagtgtaagtgtaggagagagagaagtgaggtgagatgatctgaatgctctaacaggaacattcataactatatagttacccagaatttgtctcccagtggcaaacattccactaggttcaagataaataagctggccaaagactggactgtatctttgatatatatatactgtgtattttgtgtatttagaataaaaaaaatgcatttaggaaaaaa

SEQ ID NO: 3746 - DNA, 4894 bp, Homo sapiens
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3747 - DNA, 4807 bp, Homo sapiens
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3748 - DNA, 4807 bp, Homo sapiens
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3749 - DNA, 3467 bp, Homo sapiens
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3750 - DNA, 4898 bp, Homo sapiens
tagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattg

SEQ ID NO: 3751 - DNA, 3467 bp, Homo sapiens
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3752 - DNA, 4807 bp, Homo sapiens
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3753 - DNA, 4894 bp, Homo sapiens
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3754 - DNA, 887 bp, Homo sapiens
ttcgtcccctgggggtacagcagccgggagccaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttg

SEQ ID NO: 3755 - DNA, 4894 bp, Homo sapiens
ggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3756 - DNA, 3542 bp, Homo sapiens
ggaccgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaa

SEQ ID NO: 3757 - DNA, 3455 bp, Homo sapiens
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaa

SEQ ID NO: 3758 - DNA, 1773 bp, Homo sapiens
ggccaaatcgtcttcagagtcctccagtgaggaaagtagcagtgagagctcctctgaggaagaggaggaggaagatgaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcaccccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3759 - DNA, 2115 bp, Homo sapiens
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacag

SEQ ID NO: 3760 - DNA, 3210 bp, Homo sapiens
ggaacggtggtggcggctcggctactgctcgtggaggggaatacaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3761 - DNA, 887 bp, Homo sapiens
ttcgtcccctgggggtacagcagccgggagccaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttg

SEQ ID NO: 3762 - DNA, 3210 bp, Homo sapiens
ggaacggtggtggcggctcggctactgctcgtggaggggaatacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3763 - DNA, 4894 bp, Homo sapiens
ggaccgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3764 - DNA, 3210 bp, Homo sapiens
ggaacggtggtggcggctcggctactgctcgtggaggggaatacaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3765 - DNA, 1878 bp, Homo sapiens
ggccaaatcgtcttcagagtcctccagtgaggaaagtagcagtgagagctcctctgaggaagaggaggaggaagatgaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcaccccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3766 - DNA, 3467 bp, Homo sapiens
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3767 - DNA, 4637 bp, Homo sapiens
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattc

SEQ ID NO: 3768 - DNA, 3210 bp, Homo sapiens; identical to SEQ ID NO: 3762

SEQ ID NO: 3769 - DNA, 1773 bp, Homo sapiens; identical to SEQ ID NO: 3758

SEQ ID NO: 3770 - DNA, 3467 bp, Homo sapiens; identical to SEQ ID NO: 3766

SEQ ID NO: 3771 - DNA, 3210 bp, Homo sapiens
ggaacggtggtggcggctcggctactgctcgtggaggggaatacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3772 - DNA, 3013 bp, Homo sapiens
ggaacggtggtggcggctcggctactgctcgtggaggggaatacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattc

SEQ ID NO: 3773 - DNA, 4807 bp, Homo sapiens
ggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3774 - DNA, 887 bp, Homo sapiens
ttcgtcccctgggggtacagcagccgggagccaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttg

SEQ ID NO: 3775 - DNA, 3467 bp, Homo sapiens
cccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaaactccaggctggagtgcagtggcgtgatctcggcttactgcaacctccacttctcgggttcaagcgattctcctgcctcagcctcccaagtagccagaattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattga

SEQ ID NO: 3776 - DNA, 1773 bp, Homo sapiens; identical to SEQ ID NO: 3758

SEQ ID NO: 3777 - DNA, 887 bp, Homo sapiens; identical to SEQ ID NO: 3754

SEQ ID NO: 3778 - DNA, 887 bp, Homo sapiens
ttcgtcccctgggggtacagcagccgggagccaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttg

SEQ ID NO: 3779 - DNA, 1858 bp, Homo sapiens
ggaacggtggtggcggctcggctactgctcgtggaggggaatacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaa

SEQ ID NO: 3780 - DNA, 1773 bp, Homo sapiens; identical to SEQ ID NO: 3758

SEQ ID NO: 3781 - DNA, 4637 bp, Homo sapiens
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattc

SEQ ID NO: 3782 - DNA, 3013 bp, Homo sapiens
ggaacggtggtggcggctcggctactgctcgtggaggggaatacaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattc

SEQ ID NO: 3783 - DNA, 4898 bp, Homo sapiens
tagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattg

SEQ ID NO: 3784 - DNA, 4637 bp, Homo sapiens
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattc

SEQ ID NO: 3785 - DNA, 4898 bp, Homo sapiens; identical to SEQ ID NO: 3783

SEQ ID NO: 3786 - DNA, 3013 bp, Homo sapiens
ggaacggtggtggcggctcggctactgctcgtggaggggaatacaggctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattc

SEQ ID NO: 3787 - DNA, 4637 bp, Homo sapiens
accgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccgattcccacctcgggttgggagaggaccacggtggccaaaattcttagcttcttcctttccctcatgcagcccatggatagccagccccagaggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattc

SEQ ID NO: 3788 - DNA, 4898 bp, Homo sapiens
tagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaaactccaggctggagtgcagtggcgtgatctcggcttactgcaacctccacttctcgggttcaagcgattctcctgcctcagcctcccaagtagccaggattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattg

SEQ ID NO: 3789 - DNA, 4898 bp, Homo sapiens
tagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaaaaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctgtatactcctccacctgagatacctaccactgtcttcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttccggctttggaccttctggaggaagtggcaccaaactccaggctggagtgcagtggcgtgatctcggcttactgcaacctccacttctcgggttcaagcgattctcctgcctcagcctcccaagtagccagaattacaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattg

SEQ ID NO: 3790 - DNA, 3013 bp, Homo sapiens
ggaacggtggtggcggctcggctactgctcgtggaggggaatacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattc

SEQ ID NO: 3791 - DNA, 4893 bp, Homo sapiens
ggaccgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggattatcacaaaattataaaacagcctatggacatgggtactattaagaggagacttgaaaacaattattattgggctgcttcagagtgtatgcaagattttaataccatgttcaccaactgttacatttacaacaagcccactgatgatattgtcctaatggcacaaacgctggaaaagatattcctacagaaggttgcatcaatgccacaagaagaacaagagctggtagtgaccatccctaagaacagccacaagaagggggccaagttggcagcgctccagggcagtgttaccagtgcccatcaggtgcctgccgtctcttctgtgtcacacacagccctctatactcctccacctgagatacctaccactgtcctcaacattccccacccatcagtcatttcctctccacttctcaagtccttgcactctgctggacccccgctccttgctgttactgcagctcctccagcccagccccttgccaagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaagcggaagatggagaaccgtgattaccgggatgcacaggagtttgctgctgatgtacggcttatgttctccaactgctataagtacaatcccccagatcacgatgttgtggcaatggcacgaaagctacaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacaccattaagaagcctgtgggaaagacaaaggaggaactggctttggagaaaaagcgggaattagaaaagcggttacaagatgtcagcggacagctcaattctactaaaaagccccccaagaaagcgaatgagaaaacagagtcatcctctgcacagcaagtagcagtgtcacgccttagcgcttccagctctagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattg

SEQ ID NO: 3792 - DNA, 4637 bp, Homo sapiens; identical to SEQ ID NO: 3787

SEQ ID NO: 3793 - DNA, 5198 bp, Homo sapiens
attctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttgagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacagagatggctccgaagtcaaaaaagaaggggcaccccgggagggagcagaagaagcaccatcatcaccaccatcagcagatgcagcaggccccggctcctgtgccccagcagccgcccccgcctccccagcagcccccaccgcctccacctccgcagcagcaacagcagccgccacccccgcctcccccaccctccatgccgcagcaggcagccccggcgatgaagtcctcgcccccacccttcattgccacccaggtgcccgtcctggagccccagctcccaggcagcgtctttgaccccatcggccacttcacccagcccatcctgcacctgccgcagcctgagctgccccctcacctgccccagccgcctgagcacagcactccaccccatctcaaccagcacgcagtggtctctcctccagctttgcacaacgcactaccccagcagccatcacggcccagcaaccgagccgctgccctgcctcccaagcccgcccggcccccagccgtgtcaccagccttgacccaaacacccctgctcccacagccccccatggcccaacccccccaagtgctgctggaggatgaagagccacctgccccacccctcacctccatgcagatgcagctgtacctgcagcagctgcagaaggtgcagccccctacgccgctactcccttccgtgaaggtgcagtcccagcccccaccccccctgccgcccccaccccacccctctgtgcagcagcagctgcagcagcagccgccaccacccccaccaccccagccccagcctccaccccagcagcagcatcagccccctccacggcccgtgcacttgcagcccatgcagttttccacccacatccaacagcccccgccaccccagggccagcagcccccccatccgcccccaggccagcagccacccccgccgcagcctgccaagcctcagcaagtcatccagcaccaccattcaccccggcaccacaagtcggacccctactcaaccggtcacctccgcgaagccccctccccgcttatgatacattccccccagatgtcacagttccagagcctgacccaccagtctccaccccagcaaaacgtccagcctaagaaacaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcggccggaaatgaagcctgtggatgtcgggaggcctgtgatccggcccccagagcagaacgcaccgccaccaggggcccctgacaaggacaaacagaaacaggagccgaagactccagttgcgcccaaaaaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggta

SEQ ID NO: 3794 - DNA, 3235 bp, Homo sapiens
gacgtcagtgcgctggcggcggcggcggcggcggcggcggcggctgggctgtttgttctggtctcccgcagccgaggagccgaagcagtggcggcggcagcggctgcggcggctgccggcggtgcccgcgggcgagcgcggcctgtgagctcggcagagcggcgggcgggccccggcgccgcgcaggcagctcggggagggggcggcggcagcgggcggacggccggcgggggcggcgtgcggcctagcgtctcagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacagctttctgcaccagtggagacttcgtgtccccagggccttccccgtatcacagtcacgtgcagtgcggccgcttcagggagatgcttcgctggtttctggtggatgtggagcagactgcagctggccagccgcatcgccagtctgctgctggccctgccatcacctgggccccagccattgcctacccctccccagagtgtgctcgttgctgtgttggctgctcctgaatctgccctaactccacacgcacctggacttgcgtgtccctcctgcagttctaactaacagtcccttcttttcaagccccgtgggtctgcacgttggaccctgggttccccattagagcccaccttctgagcagcagcctcagtgggaggtggaggcaggtagtgatgctgggtgccaggtgggagtggagaggggactgctctcctccaagtgtgcactttcctcattattctcaggggcgcagatgctcaggctggcgcaggggagaggctagggagggagccatggtgcccagaaggcctggcgaccagcccctgctgagagatggagctaacatcctgtgtttacggccaacggggttgccgctaggctggtgcagctgtcagtgagctggcgtgctgcagaccacctgagagctggccctagggtctcaggcagactggggagtggggatccacagtgggaaacctgtgttttggcagtagactcctgcatgttctcccacgggcctgtcccatccctgggattttattctaactagaaataaatgctaaccctc

SEQ ID NO: 3795 - DNA, 4635 bp, Homo sapiens
attctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttgagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgattactataagatcattaaaacgcctatggatatgggaacaataaagaagcgcttggaaaacaactattactggaatgctcaggaatgtatccaggacttcaacactatgtttacaaattgttacatctacaacaagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaagtctaaactggaggcccgtgagtaccgtgatgctcaggagtttggtgctgacgtccgattgatgttctccaactgctataagtacaaccctcctgaccatgaggtggtggccatggcccgcaagctccaggatgtgttcgaaatgcgctttgccaagatgccggacgagcctgaggagccagtggtggccgtgtcctccccggcagtgccccctcccaccaaggttgtggccccgccctcatccagcgacagcagcagcgatagctcctcggacagtgacagttcgactgatgactctgaggaggagcgagcccagcggctggctgagctccaggagcagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgagcaagaaggagccagcgcccatgaagagcaagccccctcccacgtatgagtcggaggaagaggacaagtgcaagcctatgtcctatgaggagaagcggcagctcagcttggacatcaacaagctccccggcgagaagctgggccgcgtggtgcacatcatccagtcacgggagccctccctgaagaattccaaccccgacgagattgaaatcgactttgagaccctgaagccgtccacactgcgtgagctggagcgctatgtcacctcctgtttgcggaagaaaaggaaacctcaagctgagaaagttgatgtgattgccggctcctccaagatgaagggcttctcgtcctcagagtcggagagctccagtgagtccagctcctctgacagcgaagactccgaaacaggtcctgcctaatcattggacacggactcttaataaaacggtcttcagttccagattccttcccagcaagctatagcttaagtccattttcttccgtgaaagggacaggactccatcaagttatggaattcctcagagccctgggcctgtcccccggggtggattagtcatgtccagcagcacacgcctagtcccgccttcgggaaggctgcctgcctggccagccgcccaggcctctctgtgtaaagactgcctggctgtcctgcccagccttcctggttctctggggtcctctgggtgggtggcatctcctggagggtgatgacaatccccaacacatgcattcatgtggtgctactctgtgtgcaaagccagaccccaagtatgttttctctctttgtcccatccctctttttctgggactttggaccctaactacttccctcctgaaccttgcagtgacatcagtccaggagagctctcgttcagtgtgcggaagaacactctgacctctagagctgtcctagataaggagtgggagctttagaggcaaggcctctagaccctggaaggctcagtgaggctcttcccacagcatgcttctcactggtgccctgtaaggctcgagccaccgctgactctgagccttttggagtctttcctccttcgtctccattgttcccgtgcatttccaaaagcttaagttgcctggtgggcatttccccagtttctttggcctccgtcttctcaagtcacatagggaaagtacctcctggaaccaggctgcagtatgcaggacctgccaggcaggcactggtgaagggccttgggcctatcatccccccaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctcattagacttaagctgtcacctgtgcttggtgccccaggaacagccagagaggacagtgcccactcacttcttgttggcagcctcctgtgcaggaagtgccagccgggcctcgacgcaccagctggctgtgggtcctgaggaggggcgggaggcggccgctcagtgcagatggggactcctctcctctgccctgaccttaccctccattacctccttcactggagtggggctggggggtgggtggaatcagtgttttaatcggatttttaaaaaacattttatttctttgtacaattaccatcctatgtaaagatgaaatttgtgttgagttgaagattgtcatggaataaagatcacaccgtacttgaggccatcttcatgtaa

SEQ ID NO: 3796 - DNA, 3696 bp, Homo sapiens
tataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccagttcctcttaggtcttggactggtgtggatcgctgctgcctgtactgtaattttggaaatgcaggagaaagtacggagcgtttagctttagctggcattttgtgtttattctgcaagtggtcatttgggacggggaagttcgggttcttgcttcatttatttattcaattaactttattaagcccctggaacgtctgaaccctcttttgggtactgcaggattgtggtgggctttacttcaaggcgcgctggcctgtattaagaattaagatagaggaggccgggtgcagtggctcgcccctgtaatctcagcactttcggaggccgaggcaagtggatcacctgaggtcaggagttcaagaccagcctggccaacataatgaaatgcccatctctaccaaaaatacaaaaattagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttaca

SEQ ID NO: 3797 - DNA, 534 bp, Homo sapiens
acaacaaaaactggcggcgaggaactgcggagaactgttgccctgcaccgcttcattttgtgcagcctgaaaggggcaatcacataaggattgtggtgggctttacttcaaggcgcgctggcctgtattaagaattaagatagaggaggccgggtgcagtggctcgcccctgtaatctcagcactttcggaggccgaggcaagtggatcacctgaggtcaggagttcaagaccagcctggccaacataatgaaatgcccatctctaccaaaaatacaaaaattagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggacatgtacttgtagacaggattcaaagcagttaagaatgtctctgccaagtcgacaaacagctattattgttaaccct

SEQ ID NO: 3798 - DNA, 3409 bp, Homo sapiens
tataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccagttcctcttaggtcttggactggtgtggatcgctgctgcctgtactgtaattttggaaatgcaggagaaagacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttaca

SEQ ID NO: 3799 - DNA, 3004 bp, Homo sapiens
ataaaagcgcctgtcgcgcgaccgccattacaacaaaaactggcggcgaggaactgcggagaactgttgccctgcaccgcttcattttgtgcagcctgaaaggggcaatcacataaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcactt

SEQ ID NO: 3800 - DNA, 3345 bp, Homo sapiens
tataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacattttt

SEQ ID NO: 3801 - DNA, 3125 bp, Homo sapiens
aagagcattttaagaatcataatagttcagtgcagatgttcctgggaggtcaagttaagagtcaaaaataattcattagatttaacaatttagcatggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaatcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctgctaagaaaataatgatgtccaaagaagaacttcactcacagaaaaaacaggaattggaaaagcggttactggatgttaataatcagttaaattctagaaaacgtcaaacaaaatctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcagaaatgttccctaagtttacagaagtaaaaccaaatgattctccttctaaagagaatgtaaagaaaatgaagaatgaatgcataccgcctgaaggaagaacaggcgtcacacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtgattctgaacagctctcaaatggcataactgtgatgcatccatctggtgatagtgacacaacgatgttagaatctgaatgtcaagctcctgtacagaaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcaatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttaca

SEQ ID NO: 3802 - DNA, 760 bp, Homo sapiens
ataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaat

SEQ ID NO: 3803 - DNA, 1707 bp, Homo sapiens
acaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaa

SEQ ID NO: 3804 - DNA, 1363 bp, Homo sapiens
attacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccaggtcttggactggtgtggatcgctgctgcctgtactgtaattttggaaatgcaggagaaagtacggagcgtttagctttagctggcattttgtgtttattctgcaagtggtcatttgggacggggaagttcgggttcttgcttcatttatttattcaattaactttattaagcccctggaacgtctgaaccctcttttgggtactgcaggattgtggtgggctttacttcaaggcgcgctggcctgtattaagaattaagatagaggaggccgggtgcagtggctcgcccctgtaatctcagcactttcggaggccgaggcaagtggatcacctgaggtcaggagttcaagaccagcctggccaacataatgaaatgcccatctctaccaaaaatacaaaaattagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctg

SEQ ID NO: 3805 - DNA, 788 bp, Homo sapiens
gtcgcgcgaccgccattacaacaaaaactggcggcgaggaactgcggagaactgttgccctgcaccgcttcattttgtgcagcctgaaaggggcaatcacataagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagtt

SEQ ID NO: 3806 - DNA, 591 bp, Homo sapiens
acaacaaaaactggcggcgaggaactgcggagaactgttgccctgcaccgcttcattttgtgcagcctgaaaggggcaatcacataaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctg

SEQ ID NO: 3807 - DNA, 550 bp, Homo sapiens
attacaacaaaaactggcggcgaggaactgcggagaactgttgccctgcaccgcttcattttgtgcagcctgaaaggggcaatcacataagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagagatagctgctatggctgggcgatctcagaggatcgcctgagtcgctcacgcctgtaatcccagcacttaggaggccgaggcgggtggatcacctgaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggcccttt

SEQ ID NO: 3808 - DNA, 559 bp, Homo sapiens
aacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccaggttcacagcaaaactgagcagtaaatagtgttcccatctaccccgtttcaacactagtacagcaccagagtggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaa

SEQ ID NO: 3809 - DNA, 551 bp, Homo sapiens
actgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggacatgtacttgtagacaggattcaaagcagttaagaatgtctctgccaagtcgacaaacagctattattgttaaccctcctccaccagaatatataaatactaagaaaaatgggcgattgacaaatcaact

SEQ ID NO: 3810 - DNA, 1744 bp, Homo sapiens
tataaaagcgcctgtcgcgcgaccgccattacaacaaaaactggcggcgaggaactgcggagaactgttgccctgcaccgcttcattttgtgcagcctgaaaggggcaatcacataaggtcggttttgtaatatacaggtaacatacaggtaatgtaccctccacagggggtgctgccttaggccggccccgaggtgcggccttgggtgggaacaaccgttttttcccccctctcccctccccgaccccatcaacatcgtgcgacagtccgggcagttgagaaggccaccccgcttcgtgcctgcagcccaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaatgttctcaaattgttatttatataacaagcctggagatgacattgttcttatggcacaagctctagagaagctgtttatgcagaaattatctcagatgccacaagaagagcaagttgtgggtgttaaggaaagaatcaagaaaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggagaaaatggataaccaagaatataaggatgcatacaaatttgcggcagatgttagattaatgttcatgaattgctacaagtacaatcctccagatcacgaagttgtgacaatggcaagaatgcttcaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcagcttaaagctgtacatcaacagctccaggttttgtcccaagtacctttccgtaagctaaataaaaagaaagagaagtctaaaaaggaaaagaaaaaagaaaagaaaaaa

SEQ ID NO: 3811 - DNA, 569 bp, Homo sapiens
aacaaaaactggcggcgaggaactgcggagaactgttgccctgcaccgcttcattttgtgcagcctgaaaggggcaatcacataaggtcggttttgtaatatacaggtaacatacagtccgggcagttgagaaggccaccccgcttcgtgcctgcagcccagttcctcttaggtcttggactggtgtggatcgctgctgcctgtactgtaattttggaaatgcaggagaaagacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactacagttgcctgattattataccattataaaaaacccaatggatttaaatacaattaagaagcgcttggagaataaatattatgcgaaggcttcagaatgtatagaagacttcaatacaa

SEQ ID NO: 3812 - DNA, 6954 bp, Homo sapiens
cggcgcccggccatggcggtctccaggctagatcgcctttttattttactggatactggcactactcctgttacaagaaaagctgctgcacagcaacttggagaagtggtgaagcttcatccccatgaactaaataatctcctgtctaaagtgttgatatatttaaggagtgcaaattgggatacccggattgcagcaggacaagctgttgaagctatagtgaaaaatgtacctgagtggaatccagtgccgagaaccagacaagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctactcttcaggcagctgaattgattgactcagagtttcgagcaggaatgagcaatagacaaaagaacaaagctaaaagaatggccaagttatttgcaaaacagagatccagggatgcagtggaaactaatgagaagagcaatgatagcactgatggggagccagaagaaaagagacggaaaatagcaaatgttgttattaatcagtctgcaaatgattccaaagtcttgattgataatattccagacagctcttccttaattgaagagacaaatgaatggcctttggaaagcttttgtgaagaactttgcaatgacctttttaatccctcctgggaggttcgacatggtgcaggcactggacttagggaaattcttaaagctcatgggaaaagtggtggtaaaatgggtgacagcactttagaagagatgattcagcagcatcaagagtggttggaagacttggttattagactcctttgtgtttttgcattagacagatttggagactttgtttctgatgaagttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggatgtaattaatactttattgcctaaagttttaactagaataattgaaggactccaggatcttgatgatgatgtcagagctgttgctgcagcatcattagtgcctgtagtagaaagccttgtctatcttcagacacaaaaggtgcccttcattataaatacattgtgggatgctcttctggaattagatgatctaacagcttcaacaaatagtattatgactctcctttcatccttgttaacttaccctcaggtccaacaatgcagtattcagcagtcactgacagttttagttccacgtgtctggccttttttgcatcacactatatcatcagttcgaagagcagcattggaaactctgtttacgttattatcaacacaggaccagaactcttcatcttggcttatacctatactgcctgatatgctccgacacatttttcagttctgtgttttggaaagcagccaggaaattctggaccttattcacaaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggaaaaaacaggtggtaaggtgcgccaaggccaaagccagaataaagaagtacttcaggagtatattgcaggtgccgacaccatcatggaagacccagccaccagggattttgtagttatgcgggccagaatgatggcagccaagttgttaggagcactttgttgctgtatttgtgatccaggtgtaaatgtggtaactcaagaaattaaaccagctgaatccctgggccagttactactcttccatttgaactccaagtctgctttacagaggattagtgtagctttggtaatctgtgaatgggctgctttacaaaaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggatccacctcagaaaaagatggaatgcaccatactgtcaccaagcacagaggtataattacactctacaggcaccagaaagctgcctttgctatcacaagtaggcgaggtcctacccccaaagcagtaaaagctcaaatagcagatcttcctgcaggaagtagtggaaatattcttgttgaacttgatgaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttgatggaaaatccctcctggataagggagatagccctgctcaagaattggtgaattctctgcaggtttttgaaacagcagcagcttcaatggattctgagcttcatcccttgttggtccagcatttgccacatctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctgtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaa

SEQ ID NO: 3813 - DNA, 3488 bp, Homo sapiens
aaactctggttcaaaaatactgaagattacaggagaactgcgcttactaggctcacttcaggtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgttaatgtgaaatggtttaaattttacatgctgaaaagctgcagagcagaggaaccaaaccaggtttatttgtgctaccaggaggtgttcttaatgggaacaggcctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgt

SEQ ID NO: 3814 - DNA, 2522 bp, Homo sapiens
ctttatatgtgccttcaataccccagtactgcagtgaggcacatggctgctcgttgtgtaggtgtcatgagcaaaatagctaccatggaaacaatgaatatttttttggagaaggttcttccgtggctgggagcaattgatgacagtgtcaaacaagagggtgcaattgaagcacttgcctatatttcacagagctcaaaagatggatgaagatcaaatcagtagaaactctggttcaaaaatactgaagattacaggagaactgcgcttactaggctcacttcaggtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggcaggcattccagaccctccaaacatgtcagcagaattaatccaattgaaagccaaggagcgacactttttggagcaattgttagatgggaaaaaattggaaaattataaaattccagtaccaatcaatgctgaactcagaaaatatcagcaggatggtgtgaactggttagcatttcttaataagtataaacttcatggaattctgtgtgatgacatgggtttaggaaaaactttacagtccatctgcattctagcaggagatcattgtcatagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggttacagcaccaagtaaaaaggcacaatctaatagtggcttcatatgatgttgtgaggaatgacatagatttctttagaaatattaaatttaactactgcattcttgatgaaggccatgtcatcaaaaatggaaaaacaaagttgtcaaaagcagtaaaacaactgactgctaattataggattattctttctggaacaccaatccagaacaacgttttggagctgtggtcattatttgatttcctcatgccaggatttttgggtactgaacgccagtttgctgctcgatatggtaaacctatattagcaagtagggatgctcgaagctccagtcgagagcaagaagcaggtgttcttgctatggatgcgctgcaccgccaagtactaccgtttcttttgagaagaatgaaagaagatgttttgcaggatcttccacctaaaattattcaagactattattgtactcttagtcctctccaggttcagctctatgaagattttgctaagtctcgtgccaagtgtgatgttgatgaaacagtttcttcagctacactttctgaagaaactgaaaaaccaaagcttaaagctacaggccacgtattccaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaattgctgttggactgcggtttgggaaatggcagcacttccgagagtggcacagagtctgttgtggcccagcacaggatactgatattctgtcagctgaaaagcatgcttgatatagtagagcatgatctcctcaaacctcacttgccctctgtcacttatttgagattagatggcagcatacctcctggtcagaggcattccattgtttcccggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcagaaacgtgtggttaacgtataccgattgataaccagaggaacattggaagaaaaaataatggggttgcagaaattcaagatgaacatagcgaatactgttattagccaagagaattctagtttgcagagcatggggactgatcagcttcttgatctgtttactcttgataaggatggcaaagcagaaaaagctgacacctctacttctgggaaagcaagtatgaaatcaattcttgaaaacctgagtgatctttgggatcaagagcagtatgattcagagtacagcctggaaaattttatgcattctctcaagtaactatcaaatattgtaaatgcaattgctgctagttcagttacatttctgctgatattcagcaaatttctaagtttatggtgaacttttaactcaatgtgtaaatagatctggagaatattcagcataatgctggctcttgtttcactgggggaaacaagttattctcaaatatttgcactgtattaaatttaaatgtt

SEQ ID NO: 3815 - DNA, 2621 bp, Homo sapiens
ggccggctccgcagcgccgcgcaggcgccccagggccacgccgaaccgagcccctcctgctccgtctaggagtcaaaatggcggcgaggggaacctggagcagtcccggagcctgagccactgacaggagaggagagggcggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaagaggagactacagtcatcaggcctgcctgtgcagcagagctttcaaacagctgcttactgcctcaatcttaaatatgaaaacccatccaaggataactggacatttgaggaaagcttccaaattgagacagagatcagagcaaaaagaacaaagtcctggaggaagcagacaatgaagggagcagaagaaaacttcagtagaatcaaaatatccttatataaaagaactttttatggaatcagtgagacataagcaggatgctattaaagtaaaaacaggagcttttagaaataagatagcagaaatgaaagatataatggaagcattgaaaggtacagttgaggaaatctagaaagtaaataatataataaagagatgagtggagacaaataaaactagagtattcatccagggtctaacatctaacaaatagtggctttagaaatatataccagagaaaagtgaagagaagacagtatctaaggagtaatataagaaatatttccaaaactaaaggaatttctatataaaaagtttctttttcagaacactggggaaaaagagacaattttaaaatgttgcagggaggagaaaaattaggttccatgcaaagaaataggaatcagatggtattgagattttcagtagcaacaactgaataccacaatacagtgaagtagtgtcttccaaaagctgatggaaaattattttaaacacaaaatcctatatttagccaaacagtcaatcaagtgtaaggctaaataaaggcatttttcagtcatacctcgaaaaactgcctgtgtagggatatttcccctgcttccccactcaggcagctgctgggaatgtattccaccaaatgacgaagcaaaccaagaacaaagaagtgaaggatctagaaaatgggctccaacacgggaaggaagcaaagggagatcccacgcatcagccacacagtaggtcttgtgggcattcagtctagcccagaccgggagggtgaaagtctccaaggaaagaggtgtctcggaagaaatcaattactttcaatgtttgaacattaaatagcaaatgacaaagcaa

SEQ ID NO: 3816 - DNA, 8430 bp, Homo sapiens
gtcaaaatggcggcgaggggaacctggagcagtcccggagcctgagccactgacaggagaggagagggcggcggcggcggcggtgggaggaggatggccgggggtgctggcgccggtgcggacggcggtgctggtggcggcggcggcggaggcgacggcagcggtcccagcggcagcagcagcggcgggaggagcctccgggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcatttttaagaacaagcaggctggcactttttatttctctttacaaatgatggaatttttttgcacttgtacatttattttctctgtattgattttatatcagtatgttaaactttattgccacatttaaaggactgtattttcatacttttttgcattttacctttcatctaccaatccatgtgcattggattgcacactaagatgtattttcttacgaaatagttctgtgtttattttttaattatagaaattccaaagaacagcacatcagaatgctcctctcttttcagtaattgttttagttcagagatcttcccgctcagcctccataaatctaatgtcattttttttttaataagtcctaggagctgggcttcattcctccagcgggagtccagtcagggtcctgaagtttgctggttcaggaaagaacaggaaagagaaaagccttctgtgcccaggctaaagctgttacatttccacagtgtggatgcagtcagaatccctgcacattctggtcataaggattagagtcaccagatgaggctctaaacagatcgcatcccttggaattagaaagcagtggagaccgggcgcagtgactcacacctgtgatcggcacttcggaaggccgaggcgggcagatcactgaagctcaggagttcaagaccagcctgggcaacatggcgaaactccatttctataaaaaatacaaaaaaaaaaaaatctagccaggcgtggtggtgcgtgcctgtagtcccagctacttggggggctgaggtggcaggatcgcttgagcctgggaggttgagactgcagtgagccaagattgcaccactgtgctcccacctgggcaacagtgagaccctgtctcaaaaaaaaaaaaaaaggcagtggaaatagagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacccgttaggctttgaggcttttcagtgaattcttgacatttaaatcttcttatagaattctttatgaagccttaactaattcttgtttttgcttcctcagaaactttttattgcatctgccatccttcattggatttttgttttggtttgttgttgccattctagcaatgagcttagtccttgtacatctgcattaaggtgccgatgcagaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaa

SEQ ID NO: 3817 - DNA, 2479 bp, Homo sapiens
ttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcat

SEQ ID NO: 3818 - DNA, 2697 bp, Homo sapiens
ctcctgctccgtctaggagtcaaaatggcggcgaggggaacctggagcagtcccggagcctgagccactgacaggagaggagagggcggcggcggcggcggtgggaggaggatggccgggggtgctggcgccggtgcggacggcggtgctggtggcggcggcggcggaggcgacggcagcggtcccagcggcagcagcagcggcgggaggagcctccggggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggcaagtgaacaagatatccttaaatatctgattaaatggggagagcatcagttgatgaaaagaatagcagatagagagccaaacttactgagtggcactgcccatagtgtgaacaaaagaggtgtaaaaagacgggacctggacatggaagagctcagagagatcctttcttctctcttaccttttgtgcgaattgaacacatcttacctataaacagtgaagtcttaagtgatgcaatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaagtcagtgctagatgagatgatggtggaacaaacggatcttgtgcgcttgcgaatggttagaatgtccaatgtgccagacacgctctacatggtcaataatgccgtgccacagtgttgtcacatgatcagccaccagcagatcagcagcaaccagtcaagccctccttcagttgtagccaacgaaattccagttcctcgtctcctcattatgaaagacatggtcagacgactgcaggaactgcggcacacggagcaggtgcagagggcctatgccctgaactgcggggaaggcgccactgtcagctatgaaattcagattcgagtgctaagagagtttggtcttgcagatgctgctgcagagctgttgcagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtgcgaacacaacctgtgctgaatgatctgatgccagacatcgcggtgggtgtgtccacactgtcactcaaggacaggaggcttccagagcttgctgtagacacagaattaagccagtcagtttctgaagcaggaccagggcctccccagcatctgtcgtgtattccacagagacatacacacacttctcggaaaaaacacacactagagcaaaaaacagacaccagagaaaatccacaggaatatccggatttctatgacttctcaaatgctgcttgcagaccttctactcctgctctcagcagacgcaccccttccccttcgcaaggtggatattttggtcccgatctgtacagccacaataaggcatcaccaagtggcttaaagtcagcctacctacctggtcagacgtctcctaaaaaacaggaagaagctaggagagaatatccactttcccctgacgggcatctacacagacaaaagaatgagccgatacacctggatgtcgttgagcaacctccccagcggtcagactttcctttggcagccccagaaaatgctagtaccggtccagcccatgtcaggggacgaactgcagtagaaactgacttgacttttgggctgactcctaacagaccttcactttctgcatgtagctctgaagctcccgaagagagatccggtagaagactggcagacagtgagtccctgggccatggagctcagagaaatacagatttggaaagggaagattcaataagcagaggaaggaggtcaccaagcaagccggacttcctctacaaaaagtctgccctctgagagcaacctccaagtcgtctgtgcctgagatgtgaaacatcccattttatgatgtaacccaacaacttacagaccagttcatcaatgccagctgataactcggtttcacatgattttgttctagtttttgtgtatatatgtgtttattagacatggcatgctaagaaggttttgttttttttttttaatgttgcatctgtctaatttgtctttgaacaattatgtcgggaggcattttta

SEQ ID NO: 3819 - DNA, 316 bp, Homo sapiens
aggcctgaggactgctactcccaggggaagttagattgtccggaaatggatgaaaagaggctgctggatccagggttgaaggttcataaaggcctctgggattatactctgaagaacccgcagacggaatgcctgagtgactgaagaaaatgggtgctaatgcatctaattatcctcattcatgttccccgagggtagggggaaattcacaggcccaacagacttttatagggacctcatcctattctcagcaaggctatggttgcgaatcaaagttgtatagccttgaccatggccatgagaaaccacaagacaa

SEQ ID NO: 3820 - DNA, 8486 bp, Homo sapiens
agataaggaattgtataggaggaaacttcatagtaaacattgaacctctgtgcttgtctccttgttgaagttgggggttcatgtttattgttccaagggagcctcatcaaaaccacttttaaagcattgagaatccaaataaataccatggatcatacaggattggggataagtcttgaggtctccccgagaaggagaagttctttaatttggtaattttagggtaatggttggatgctctctggattaatggaaaccttcaggggtacttttaggcagagtataacccagtgaagagagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgacttggtgggctcgggcaacggcaggaaacggtctcctccctgagcaggggtctctgttgactgcccccacctctgcccctttccagggaggagccgacctagctgcaaaagcagacaccgaacaggttttctcccaaggacagaaaggggctgctttgttcttctcaatttatccaaatcaggcaggtctcaagggggagaaaatgggtcttcaatcttcatcaagtccaccattaacaccctacctctctaatctagcccaggcgcagggaacaggaggaagtcatagacaggcctgtgttggaatacaaaaatggcacgcaaacactcaggcggaggagaaagccattgggcctttgctacctggaggcaccctttaggaatgggcctccatagagtgttcattctgctggaatacattgccctggcaactaaatgattttttatttgttttagttattctccactcagtgaatcataggtgttccggatctatttgaaatgctcaaacagcaaatcactagttttaatcccttttgatgctataattttccttccttggttttgaacggttcagcttgcggggacagagacccatcgtgcatgtctcctaaatgagacacggatgcagctcatcctggcacttgggccacagaggaagtgccacaaatgcacacaagcaaatcaacctgtggacactggagttaatagtcactcgtgtggctgagttactcacctgtcattcctgacatggatccagcctttaagcttgggaggctgacaaggaaatagttactatgcccgctgctaattcactgttccgaagtccatgtagataaacatataccgagttctggcgtggccaaacctgccggggactgccgtggcttagctgcccctccagttgtgtttatcgaagcattggagaggcagccacctgcccatcagcgtcaggaacgcagaactgggactccgtgcttcccccacaccacagtactcaactggggactgaaaaatagcagttccaagaagcttttctcctaatcctcatcaaaaggacctcatttgacgatggtggcttgatgtggctccgtctcctacttagtgatttccattccagtgctgcctgccctgggtaactgcgcacaacattgcctgcccctccgctgtccccagagctccggcctctgtcgccatcagcatcagcctgggagtctccccaggacggcatggcacgtgagcagcactgcagtccttgggtcttcggcgccaacctgcaaccctgatcaaaggagggtgagggcgtgggagtttcctttcaggtgtgtcaaagacatatcagctgcgctctagaaagagccaacgggtcagccgcttcctcctagtttaacttgattttgagtgatttgtccatatggaaatagtagggtagcatcaaactgcgtgattaaattggaagactgtctttccgtgtgaacacaggatggcagacatcagagggctaccggggcagggtggacacgttcctgaggagaagccagggtctgcagctctccatcctccccggtagctccagctgcagggctgagctgcttcctatcccctcagctctgatctctgccacttccctgttgtgtgggagagtggaacactcctgggatgccaggcatttcataatgggaggaggctcctgtaaggaacggtgggcgcccgctcacagtggggggccctccagcatggttgctgactctgtcagcccccagccccgggttgccaattagccagagagctcctgcacacacagcacttccttccccagtgtgttttctacccagatggggacaaaggagccagacagtcatatcaagggcagagttcaaacattttgaaatgagccattcacatgcttctttttaaacatgggcatcacctgcccagaggcccttggcctgaagcagcatgctgctgaccttgggaagagagggtgggctggtgggggtgctggaggagctgcccggccctgcatctgcaaccctccagtcccctgcccacagagcacgcagagccctcctgtgctccgggaacgagatagcagcttggcagctcggcctcgcatctgaaaaggaatacgctgcaaagcctcggccctagacccacatctgcagctccctggcctgtggcggttctttccttcggggcatgcccttccagatctctgtccctcctgtcttctagcactttaaagatgccccttatcatcagataaagagaagtatggggacgatggggtggcactaacagtagatgtcattggtgaggactgatggcaaagtctcattccctcacagccgcgctgccagctcgcctccccctcgctttgctgggagcctgccctggactccaaaaggacacgggttcacctcctttcccaggctggaggggtactgcccttccctgaggggccttctgactggggcaggaactcttttcgtgtgtccagctgggcctggaggccaagtcaaggtgtgtcacaccacacaccagggcaaggacctcatctccagggaacagggacaagtgagtggctaccagaaagtccccgggcagcctggagttccccagagcctggctggtcctacagagcacttctcccctgggccaccaggaccaaagcgacctaaacacttgaagctaaaagcaagtgctgatgatgggatgggctggcacgtggctgggagggctcctgggcaccacagagccctcagcccagcagagagtggaggctcagtccgtggggagcgggggttgtgaaggagacatggccaagcccctggtcggggagataagctcccccatgcccaggccagccccaggggcaacaagccaacatggagagaggtggcaggtgaggctgacaggtgggtgcctgtggcctgggcccatgagggcaatggtcctcagtaaccaatggaaaggacacaagggcgccatggtcaccaccacccaggcaaagaaatgggaggtggccagcacccccacccttcacttttcattattattattattattattattattattttttttttttttttttttttttttttttttttttgagagtagaaaggcaacttcattggagcttttggggaaaaaagccttcaaagtcaccttctggcagctctggggagggtcatttggggtggactgagagtgtagggcaggtagggtgtgtgctgggcagcagctgtgtccatgcagccagcacccagcagggcagtctcacaggagccgttgtgagcactttggacttgaagcagctatgaaccaccccccgcccccaccgtctctccctctcacacacacacacacacacacacacacacacacacacacacacacacacccgttttaccattttctcagtgctttttctgctttcattcctttgattttagttagaagcacaagccatgatggatgtgggactcttctcaattgctctttaaattgtcactttttaaatcctattaaatgaagtgtcgattcctgacaaatacattaaaagtgttttattcctagaagagttgggaaaagaaattattttcagcaagagtaggatgtttgttaaactgattccttggcaaaaaagagaaaaaaagcttttgaattgtgcaaaaaattgcccagtattatgctgtcgccccagttgtcaaactgctgtgcagatggctccagcccagtcaacttcaccttctttttaatttagaagataacaaaattgtaatcacttatcctttccagagccaagggggaaaaggaaggtataatctacaataaaaagcgagcgttctgtgtactgaggccacttggtgataaagagatggagcgctcccctcacagacttcaattaagaacctccctttggacagggaagaaaggtgtcaaagaggaaaagaaaattaaatttgcttccttccaggagtttttcctcattagtgcttgcttgtcggtgttattattttaatcttaccttctatgtggtgaccagctcctccgagcgatgcccaggtcgggcacggcccgggcagggcaggtctgcagcgatgccgtggcagaggtgggcatactccatttgttttggcagctgcagccattgattctgcatatttttcctgacaacagccccggcaggagttcagttaggaatttaaagtgcagttcatggttctgtgccaccgtggcttttattattataatattaaattagaagttgtcctagtgcctggtgtttgctcagagtttccagaagagagggaagggcaaggtttaaatggcatgcaggacaactggaatgcccccatctctctcgctgacacggatccagtcatacctggggctggacgggatttggaggccctggtcatttgcagagtgaatggtgaagggcgcggaaaaggtttgcttggaggaaagaccggttgcagaggcgaggcggagggaggaggggcggaggcagcaggtctttgtttgtggtaggtctctggcttccatcagggaggaggaaagaggctgtgcccttcctggctcttggctgcaccactgaggacgctccgagggacagcgtgctcacccatcctttgcacagtgctggccccaagccccacggccttccagctaggattttctgctgggctcatgcagaggcaggggacaggtgcatggaagagccgccccacccgacacaccattgtttgaaaatcactgttctctttactcacttaaaaaagtgtacagggaacacctgttcctggcataatgctccaacctcgcggaaggggccaggtgcccttcatctggctctggctgcttccgacctgggcccacgtcatcgttcacgtcctctgtgaccaccactggtcacggtgctccctggcccagcctccaacccacccagcaccctggcatctcccaggccagtctgctgcacccagcgagcttccagtcagaagccaggctgaacggccctcctgccccatcagcttcgtgtcttcttttttttaaagaactgaaatagtccccaagaggcctcatggcctgaagactcacaatcatccacctgtaatttatgataaatgtctgggagcatttaccatttgcgtccgtgagtatttatagccctgaatgggcgggggggagggggggtggaggaggccctgcagccaggagctacacacctgtccccactagtgtcccctggttgacagagccccctcagcctccccaaggctgtcactgcggctgtgacagctgaggagtgccgcctttgaaagccagtggacagtcgctccactagggggagaggccctggccctggcgcagaggaggcgttgcgaggcgggacgggggctggaggggctgagcagccttcagggcagggactgggccctgggtcactggagacgttgatattagtccgtctgctgccaaattgctccccaccacatgagccccaggggtttatgtcccaggaaggcgagggtgcccatctgagcggaattgggaggggacggcaccagctcatctccctcagggcctttgcctcctggtgctgccctggtggctgctcctgcaccacagcccctgatggctgctgctagtcctgagttgctgggtttacccccagcccacacttcccacctgggcctgagggtgcggccagtgccctagtcctagccactacaggagtcattctgagacctgctggaggccatggggtcttcccaggcccctcaatcagctgcttccagggtcagcagggcagggtgctgccagtaaggtcctcagggagcacagcccggccgcccaggctgggggatactggggcagagcttccaggtctgtggggcctgatctctccccaaggctctccaggccttggtgcgccctccacagtgaccttcagagaggctgcaccccctcagaagaacagtgagaaatctctccatcacacgctccctggtccttatgtccctgaggccacccttccccaccccccagtgcctggagaagcgtgagactctggaggggcgccaggaggccaggggtcctcagggctaggcctggagctcggcccaagagctgcttttgcgaagcctgtcttgaatccggattcaccagagaacaagagcctcccagcctttggcgtttctgggcctgtaaagatgtgtgtacctcccaggccactctgatgcaagggcagggaccatgccaggcctgggttgggaatggctctgtgactccagaagctccgtctaaaactccaaagatgcccaaaaggctgtgctgctatgtggaatgtgtattatttgtgagcacgatgcggcttcttcctcattttgcagagcaacctaagcgggcagatgtacaaaccgtgtgttcgaaacccctgagtccatgtgtgtgaaaatgcaggttttctcttagaaataaagtggtgacttgtgctgta

SEQ ID NO: 3821 - DNA, 1839 bp, Homo sapiens
atgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataa

SEQ ID NO: 3822 - DNA, 1635 bp, Homo sapiens
atgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataa

SEQ ID NO: 3823 - DNA, 8525 bp, Homo sapiens
agccggggcggcggcgaggacggcggccacggaagcggccaagggggcggtggcgcagagaggggtgcggagcgggcggaagaggcgtctgtgtcgcagcttggtctcagaggagcatcgctgggaacaacgactatcgtctattccacaagatgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgacttggtgggctcgggcaacggcaggaaacggtctcctccctgagcaggggtctctgttgactgcccccacctctgcccctttccagggaggagccgacctagctgcaaaagcagacaccgaacaggttttctcccaaggacagaaaggggctgctttgttcttctcaatttatccaaatcaggcaggtctcaagggggagaaaatgggtcttcaatcttcatcaagtccaccattaacaccctacctctctaatctagcccaggcgcagggaacaggaggaagtcatagacaggcctgtgttggaatacaaaaatggcacgcaaacactcaggcggaggagaaagccattgggcctttgctacctggaggcaccctttaggaatgggcctccatagagtgttcattctgctggaatacattgccctggcaactaaatgattttttatttgttttagttattctccactcagtgaatcataggtgttccggatctatttgaaatgctcaaacagcaaatcactagttttaatcccttttgatgctataattttccttccttggttttgaacggttcagcttgcggggacagagacccatcgtgcatgtctcctaaatgagacacggatgcagctcatcctggcacttgggccacagaggaagtgccacaaatgcacacaagcaaatcaacctgtggacactggagttaatagtcactcgtgtggctgagttactcacctgtcattcctgacatggatccagcctttaagcttgggaggctgacaaggaaatagttactatgcccgctgctaattcactgttccgaagtccatgtagataaacatataccgagttctggcgtggccaaacctgccggggactgccgtggcttagctgcccctccagttgtgtttatcgaagcattggagaggcagccacctgcccatcagcgtcaggaacgcagaactgggactccgtgcttcccccacaccacagtactcaactggggactgaaaaatagcagttccaagaagcttttctcctaatcctcatcaaaaggacctcatttgacgatggtggcttgatgtggctccgtctcctacttagtgatttccattccagtgctgcctgccctgggtaactgcgcacaacattgcctgcccctccgctgtccccagagctccggcctctgtcgccatcagcatcagcctgggagtctccccaggacggcatggcacgtgagcagcactgcagtccttgggtcttcggcgccaacctgcaaccctgatcaaaggagggtgagggcgtgggagtttcctttcaggtgtgtcaaagacatatcagctgcgctctagaaagagccaacgggtcagccgcttcctcctagtttaacttgattttgagtgatttgtccatatggaaatagtagggtagcatcaaactgcgtgattaaattggaagactgtctttccgtgtgaacacaggatggcagacatcagagggctaccggggcagggtggacacgttcctgaggagaagccagggtctgcagctctccatcctccccggtagctccagctgcagggctgagctgcttcctatcccctcagctctgatctctgccacttccctgttgtgtgggagagtggaacactcctgggatgccaggcatttcataatgggaggaggctcctgtaaggaacggtgggcgcccgctcacagtggggggccctccagcatggttgctgactctgtcagcccccagccccgggttgccaattagccagagagctcctgcacacacagcacttccttccccagtgtgttttctacccagatggggacaaaggagccagacagtcatatcaagggcagagttcaaacattttgaaatgagccattcacatgcttctttttaaacatgggcatcacctgcccagaggcccttggcctgaagcagcatgctgctgaccttgggaagagagggtgggctggtgggggtgctggaggagctgcccggccctgcatctgcaaccctccagtcccctgcccacagagcacgcagagccctcctgtgctccgggaacgagatagcagcttggcagctcggcctcgcatctgaaaaggaatacgctgcaaagcctcggccctagacccacatctgcagctccctggcctgtggcggttctttccttcggggcatgcccttccagatctctgtccctcctgtcttctagcactttaaagatgccccttatcatcagataaagagaagtatggggacgatggggtggcactaacagtagatgtcattggtgaggactgatggcaaagtctcattccctcacagccgcgctgccagctcgcctccccctcgctttgctgggagcctgccctggactccaaaaggacacgggttcacctcctttcccaggctggaggggtactgcccttccctgaggggccttctgactggggcaggaactcttttcgtgtgtccagctgggcctggaggccaagtcaaggtgtgtcacaccacacaccagggcaaggacctcatctccagggaacagggacaagtgagtggctaccagaaagtccccgggcagcctggagttccccagagcctggctggtcctacagagcacttctcccctgggccaccaggaccaaagcgacctaaacacttgaagctaaaagcaagtgctgatgatgggatgggctggcacgtggctgggagggctcctgggcaccacagagccctcagcccagcagagagtggaggctcagtccgtggggagcgggggttgtgaaggagacatggccaagcccctggtcggggagataagctcccccatgcccaggccagccccaggggcaacaagccaacatggagagaggtggcaggtgaggctgacaggtgggtgcctgtggcctgggcccatgagggcaatggtcctcagtaaccaatggaaaggacacaagggcgccatggtcaccaccacccaggcaaagaaatgggaggtggccagcacccccacccttcacttttcattattattattattattattattattattttttttttttttttttttttttttttttttttttgagagtagaaaggcaacttcattggagcttttggggaaaaaagccttcaaagtcaccttctggcagctctggggagggtcatttggggtggactgagagtgtagggcaggtagggtgtgtgctgggcagcagctgtgtccatgcagccagcacccagcagggcagtctcacaggagccgttgtgagcactttggacttgaagcagctatgaaccaccccccgcccccaccgtctctccctctcacacacacacacacacacacacacacacacacacacacacacacacacccgttttaccattttctcagtgctttttctgctttcattcctttgattttagttagaagcacaagccatgatggatgtgggactcttctcaattgctctttaaattgtcactttttaaatcctattaaatgaagtgtcgattcctgacaaatacattaaaagtgttttattcctagaagagttgggaaaagaaattattttcagcaagagtaggatgtttgttaaactgattccttggcaaaaaagagaaaaaaagcttttgaattgtgcaaaaaattgcccagtattatgctgtcgccccagttgtcaaactgctgtgcagatggctccagcccagtcaacttcaccttctttttaatttagaagataacaaaattgtaatcacttatcctttccagagccaagggggaaaaggaaggtataatctacaataaaaagcgagcgttctgtgtactgaggccacttggtgataaagagatggagcgctcccctcacagacttcaattaagaacctccctttggacagggaagaaaggtgtcaaagaggaaaagaaaattaaatttgcttccttccaggagtttttcctcattagtgcttgcttgtcggtgttattattttaatcttaccttctatgtggtgaccagctcctccgagcgatgcccaggtcgggcacggcccgggcagggcaggtctgcagcgatgccgtggcagaggtgggcatactccatttgttttggcagctgcagccattgattctgcatatttttcctgacaacagccccggcaggagttcagttaggaatttaaagtgcagttcatggttctgtgccaccgtggcttttattattataatattaaattagaagttgtcctagtgcctggtgtttgctcagagtttccagaagagagggaagggcaaggtttaaatggcatgcaggacaactggaatgcccccatctctctcgctgacacggatccagtcatacctggggctggacgggatttggaggccctggtcatttgcagagtgaatggtgaagggcgcggaaaaggtttgcttggaggaaagaccggttgcagaggcgaggcggagggaggaggggcggaggcagcaggtctttgtttgtggtaggtctctggcttccatcagggaggaggaaagaggctgtgcccttcctggctcttggctgcaccactgaggacgctccgagggacagcgtgctcacccatcctttgcacagtgctggccccaagccccacggccttccagctaggattttctgctgggctcatgcagaggcaggggacaggtgcatggaagagccgccccacccgacacaccattgtttgaaaatcactgttctctttactcacttaaaaaagtgtacagggaacacctgttcctggcataatgctccaacctcgcggaaggggccaggtgcccttcatctggctctggctgcttccgacctgggcccacgtcatcgttcacgtcctctgtgaccaccactggtcacggtgctccctggcccagcctccaacccacccagcaccctggcatctcccaggccagtctgctgcacccagcgagcttccagtcagaagccaggctgaacggccctcctgccccatcagcttcgtgtcttcttttttttaaagaactgaaatagtccccaagaggcctcatggcctgaagactcacaatcatccacctgtaatttatgataaatgtctgggagcatttaccatttgcgtccgtgagtatttatagccctgaatgggcgggggggagggggggtggaggaggccctgcagccaggagctacacacctgtccccactagtgtcccctggttgacagagccccctcagcctccccaaggctgtcactgcggctgtgacagctgaggagtgccgcctttgaaagccagtggacagtcgctccactagggggagaggccctggccctggcgcagaggaggcgttgcgaggcgggacgggggctggaggggctgagcagccttcagggcagggactgggccctgggtcactggagacgttgatattagtccgtctgctgccaaattgctccccaccacatgagccccaggggtttatgtcccaggaaggcgagggtgcccatctgagcggaattgggaggggacggcaccagctcatctccctcagggcctttgcctcctggtgctgccctggtggctgctcctgcaccacagcccctgatggctgctgctagtcctgagttgctgggtttacccccagcccacacttcccacctgggcctgagggtgcggccagtgccctagtcctagccactacaggagtcattctgagacctgctggaggccatggggtcttcccaggcccctcaatcagctgcttccagggtcagcagggcagggtgctgccagtaaggtcctcagggagcacagcccggccgcccaggctgggggatactggggcagagcttccaggtctgtggggcctgatctctccccaaggctctccaggccttggtgcgccctccacagtgaccttcagagaggctgcaccccctcagaagaacagtgagaaatctctccatcacacgctccctggtccttatgtccctgaggccacccttccccaccccccagtgcctggagaagcgtgagactctggaggggcgccaggaggccaggggtcctcagggctaggcctggagctcggcccaagagctgcttttgcgaagcctgtcttgaatccggattcaccagagaacaagagcctcccagcctttggcgtttctgggcctgtaaagatgtgtgtacctcccaggccactctgatgcaagggcagggaccatgccaggcctgggttgggaatggctctgtgactccagaagctccgtctaaaactccaaagatgcccaaaaggctgtgctgctatgtggaatgtgtattatttgtgagcacgatgcggcttcttcctcattttgcagagcaacctaagcgggcagatgtacaaaccgtgtgttcgaaacccctgagtccatgtgtgtgaaaatgcaggttttctcttagaaataaagtggtgacttgtgctgta

SEQ ID NO: 3824 - DNA, 573 bp, Homo sapiens
agagaggggtgcggagcgggcggaagaggcgtctgtgtcgcagcttggtctcagaggagcatcgctgggctcgtctcaatttggccctgctgtatttcaagtgctcggtagccacatgtggcaagtggccatcactgtggccattgcagctccaaagggacaggagagttgatggaaattagacactgcattctacagcctcatgagcccaagagagcaaaccttggtttgctgaaaatcagcagataaggcaattgaaagggaagaagaacaacgactatcgtctattccacaagatgagtaacagccaccctcttcgcccctttactgcagtgggggaaattgatcatgtgcacattttgtctgaacatattggtgccttgttgattggggaagaatatggcgacgtcacattcgtggtggaaaagaaacgttttcctgcccacagggtaattttagcagccaggtgccaatattttcgagcattattatatggtggaatgcgagagtctcagcctgaagcagaaattcctctccaagacaccactgcagaagcattcacaatgctactca

SEQ ID NO: 3825 - DNA, 2034 bp, Homo sapiens
catgtttattgttccaagggagcctcatcaaaaccacttttaaagcattgagaatccaaataaataccatggatcatacaggattggggataagtcttgaggtctccccgagaaggagaagttctttaatttggtaattttagggtaatggttggatgctctctggattaatggaaaccttcaggggtacttttaggcagagtataacccagtgaagagcaaatcctatttgagggtttcttcatgtgtttcttccctgatgtgcagagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccattatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcagtggagatggagtctcactatggtgcccactctggtctcgaactcctgagctcaagcaatcctccctccttggccttccaaagtgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgactt

SEQ ID NO: 3826 - DNA, 5669 bp, Homo sapiens
gagtgagtcacctgaccgctgccctcgccgcccgccgggcgctctcgcttcagtcagtcgggccgcgccgcgcctcagctctggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaa

SEQ ID NO: 3827 - DNA, 5769 bp, Homo sapiens
gtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccccaaatacagaaaattccaaaaagcatttggaactgacagagtccgtactggggaatctagtgtcaaagacattcatgcttctgttcagccaaatgaaaggtctgaaaatgaatgcctgggaggagtcccggagtgtagagatttgcaggtgatgttaaaatgtgacgaaagtaaattagcaatggaacctgaagaaacgaagaaagatcctgcttctcagtgcccaactgaaaaatcagaagtgactcctttcccccacaattcttccatagaccctcatggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctgcaaagtgaaaaggagagcttgttgaaggaaagagatcacattttgtcaactctgggtgagacaaagcagaacctaactggactttgccagaaagtttgtaaagaagcagctctgagtcaagaacaaatacagatactcgccaagtactcagctgcagattgcccactttcatttttaatttctgaaaaagataaaagtactcctgatggtgaactggcgttaccatcaattttcagtttatctgaccggcctccagcagtgctgcctccctgtgccagaggaaacagtgagcctggctacgcgcgagggcaggagtcccagcagatgtccacagccacctctgagcaagctgggcctgcggaacagtgtcgtcagagtggtgggatctcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgttcactattttatgaactggccttctcaatgtttgatgattttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaa

SEQ ID NO: 3828 - DNA, 692 bp, Homo sapiens
gcaaaagactgttgaagtagagagcattttgcccagctcactcggattctttgctggcatgccttcagtttcagttgtcatccagagaagtcaaaggaaatgctgcttggggatgagcatgttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtgga

SEQ ID NO: 3829 - DNA, 751 bp, Homo sapiens
atacacaagaagtttcaggagtcagaggagggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttg

SEQ ID NO: 3830 - DNA, 777 bp, Homo sapiens
gcctttggacatcttgaagaagcttagggaagaaaggctcccggttgatgataattagaagcatgctttccactgaacttcccgacaacatttgttatgcagaatgtctctgagtgagaactcggtttttgcctatgaatcttctgtgcatagcaccaatgttttactcagccttaatgaccagcggaagaaagatgtgctgtgcgatgtcaccatctttgtggagggacagcggttccgcgctcaccggtccgtgctggcggcatgcagcagttacttccactcaagaatcgtaggccaggctgatggagagctgaacattactcttccagaagaggtgacagttaaaggatttgaacctttaattcagtttgcctacactgctaaactgattttaagtaaagagaatgtggatgaagtgtgcaaatgtgtggagtttttaagtgtacataatattgaggaatcctgctttcagtttctgaaatttaagtttttggactccactgcagaccagcaagaatgcccaagaaaaaaatgcttttcatcacactgtcagaaaacagaccttaaactttcacttttggaccagagggatctagaaactgatgaagtggaggaatttctggaaaataaaaatgttcagactcctcagtgtaaactccgcaggtatcaaggaaatgcaaaagcctcacctcctctacaagacagtgccagtcagacatatgagtccatgtgcttagagaaggatgctgctctggccttgccttctttatgccc

SEQ ID NO: 3831 - DNA, 485 bp, Homo sapiens
tctttgacaatgactatctggatgacacaggaaggatgcaattctggccttggagagaaaacttgcaaggaaaggaacatgtttgaatttcagatgtgttcctcaatgaatcacgatcttcagggaatgtttcaggtggaggaaggggctcttggtcaatgagcctgaagactgcatggcaacctttgccagcttttggcctgaaaactcaacttcttcatttgagattagcaaaagactgttgaagtagagagcattttgcccagctcactcggattctttgctggcatgccttcagtttcagttgtcatccagagaagtcaaaggaaatgctgcttggggatgagcatgttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 3832 - DNA, 315 bp, Homo sapiens
tctttgacaatgactatctggatgacacaggaaggatgcaattctggccttggagagaaaacttgcaaggaaaggaacatgtttgaatttcagatgtgttcctcaatgaatcacacttgttacatttactgactctcatggtggtggagatggattttttcctagtgtgcctgtgtgtgggttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 3833 - DNA, 325 bp, Homo sapiens
gaagaagctattcaaaaatgtccaggactctgttatttattcagcaagcttacaaagccatctttgattgactgattctttgacaatgactatctggatgacacaggaaggatgcaattctggccttggagagaaaacttgcaaggaaaggaacatgtttgaatttcagatgtgttcctcaatgaatcacgttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 3834 - DNA, 217 bp, Homo sapiens
ggcagtttcatgtcattgagtagaattgtgcggaatgcttttatggagtgaggcttctgcgttaaacttgtgctgattccaggttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 3835 - DNA, 349 bp, Homo sapiens
tctttgacaatgactatctggatgacacaggaaggatgcaattctggccttggagagaaaacttgcaaggaaaggaacatgtttgaatttcagatgtgttcctcaatgaatcaccacgtctccttcctgccatcttgtgaagaagtgccttgcttccctttcaccttctgccatgattgtaagtttcctgaggcctctccagccatcctgaactgttgatgataattagaagcatgctttccactgaacttcccgacaacatttgttatgcagaatgtctctgagtgagaactcggtttttgcctatgaatcttctgtgcatagcaccaatgttttactcagccttaat

SEQ ID NO: 3836 - DNA, 9113 bp, Homo sapiens
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtgttgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcgcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactg

SEQ ID NO: 3837 - DNA, 3981 bp, Homo sapiens
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtata

SEQ ID NO: 3838 - DNA, 780 bp, Homo sapiens
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggag

SEQ ID NO: 3839 - DNA, 868 bp, Homo sapiens
gcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcgttcacatagctcccagttttaacatttcgccacctactgaagacatcatttgggaccaagctgatgagcccttgaagcacagcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggag

SEQ ID NO: 3840 - DNA, 9108 bp, Homo sapiens
gtcaacaatgtagcgattgagagtgtgggcgttccggggagagcgcaagccgcgcggcgcggagcaaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtgttgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcgcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactg

SEQ ID NO: 3841 - DNA, 2712 bp, Homo sapiens
cagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgaggggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 3842 - DNA, 3507 bp, Homo sapiens
atgggcaggcgccctgaaacgttcggcgagccgactgcggctgcgcggggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgt

SEQ ID NO: 3843 - DNA, 3287 bp, Homo sapiens
attcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattagatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaa

SEQ ID NO: 3844 - DNA, 3532 bp, Homo sapiens
attcgaatcggcggcggcttctagtttgcggttcaggtttggccgctgccggccagcgtcctctggccatggacaccccggaaaatgtccttcaatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaacttagttgttataaatatttcaacaaaatatacaaccccataaggtccctatatagcaggctgattgggctgcttctgggatgcaagcatttgtgagaataattcagacatgagcattctctagaaatcacttt

SEQ ID NO: 3845 - DNA, 2506 bp, Homo sapiens
ggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtaaaatcct

SEQ ID NO: 3846 - DNA, 1361 bp, Homo sapiens
gaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 3847 - DNA, 2731 bp, Homo sapiens
gggttgaccgatgctgggcagctgagcggaccaatcggccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaatgttg

SEQ ID NO: 3848 - DNA, 1175 bp, Homo sapiens
ctagcctgcgagtgttctgagggaagcaaggaggcggcggcggccgcagcgagtggcgagtagtggaaacgttgcttctgaggggagcccaaggatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgttt

SEQ ID NO: 3849 - DNA, 1886 bp, Homo sapiens
aagaagtgaactgcttgttcacttgctgctgttgccactgctggtacagaaatagaaggtaagacagcacaaaaaaacaaagacaaaaaacctccaagctcccttcagtagttgctacaccttcagattgagacatccttcctcatttacaaacctcagctgtgtctgggggcagggccacagtgaaactgccaggagcaaaaaggcttccaagaaaaagtaccacatcagattggaaactggggacagatcattcctgggatgtgacgggcaccagaatgctccctctccaaaggatctaaggaccaaagctgacagtttctttacttgcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattccgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgcatgcctgctctaatttcttttgcccatatatgagtatctccagaatgtctacaaatagtttttgtagcaaatgaaaatttcttcaaataagccttttgtttcaaataaaacttgtctcaaaacatgcttc

SEQ ID NO: 3850 - DNA, 1596 bp, Homo sapiens
acagtatgtgaaatactctcaccagaacaaaggtcccagcgtcaataagtcaaaccgcagactctgacagctgagtgaatagcagaggccagagtccacttgaagtgttcacactctcagaggccaagtttagatcttatctgcctgagattccttttaacactgatttgtcatagcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattccgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctc

SEQ ID NO: 3851 - DNA, 1724 bp, Homo sapiens
tctgggggcagggccacagtgaaactgccaggagcaaaaaggcttccaagaaaaagtaccacatcagattggaaactggggacagatcattcctgggatgtgacgggcaccagaatgctccctctccaaaggatctaaggaccaaagctgacagtttctttacttgcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattccgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgcatgcctgctctaatttcttttgcccatatatgagtatctccagaatgtctacaaatagtttttgtagcaaatgaaaatttcttcaaataagccttttgtttcaaataaaacttgtctcaaaacatgcttcta

SEQ ID NO: 3852 - DNA, 1725 bp, Homo sapiens
gcagagaaaggagggcatcaagcttaggggaccaatccctgtctttctaccagtccctgataactactcaagctccctttaaagaggctcatattggaatactctgttgacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaaggtaagacaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattccgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgtt

SEQ ID NO: 3853 - DNA, 703 bp, Homo sapiens
gacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaaggtaagacagcacaaaaaaacaaagacaaaaaacctccaagctcccttcagtagttgctacaccttcagattgagacatccttcctcatttacaaacctcagctgtgtctgggggcagggccacagtgaaactgccaggagcaaaaaggcttccaagaaaaagtaccacatcagattggaaactggggacagatcattcctgggatgtgacgggcaccagaatgctccctctccaaaggatctaaggaccaaagctgacagtttctttacttgcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattccgcaaaagcacggaaacttctagtggaagctcttgatgtgaacattggaattaaaggcttgatatt

SEQ ID NO: 3854 - DNA, 1570 bp, Homo sapiens
agagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgggtatgagctgcctgggatcaggggaccttcatggaaacggccactacatggggaacccccttcagctttctgagacttctctggggaccaggaaccacacaatccccagggttcctgagaccccaggcataaacctgagacttcctctgcagctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctgg

SEQ ID NO: 3855 - DNA, 1068 bp, Homo sapiens
agagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctg

SEQ ID NO: 3856 - DNA, 2294 bp, Homo sapiens
cttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagag

SEQ ID NO: 3857 - DNA, 2895 bp, Homo sapiens
atctcctaggctgaagctcctgaggggactcacatcagttatcttgctgctccagaagggtgggagatggcagttttcccaagctccggtctccccagatgtctgctcaccctcattctcctccagctgcccaaactggattcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctgctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctgcgaaaaatgtgtcctgctacatccagaatctccttcttggccaggagaagaaagtagaaatatccataccagcttcctccctcccaaggctgactccctggatagtggctgtggctgtcatcctgatggttctaggacttctcaccattgggtccatatttttcacttggagactatacaacgaaagacccagagagaggaggaatgaattcagctctaaagagagactcctggaagaactcaaatggaaaaaggctaccttgcatgcagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggactctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctcccttgcctggaagtcattccaccctcaatttgttgatccacaagtttccagttgtcctcttctttttgttatagcatctctctatttcaaagacattcctagaagtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttataccttccatttccatcgtattctccagtttccaggatagacgttgctcatcgtctttacctaataaataagtttgtctgattgctg

SEQ ID NO: 3858 - DNA, 2266 bp, Homo sapiens
ctgctccagaagggtgggagatggcagttttcccaagctccggtctccccagatgtctgctcaccctcattctcctccagctgcccaaactggattcagctccctttgacgtgattggacccccggagcccatcctggccgttgtgggtgaggacgccgagctgccctgtcgcctgtctccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctgctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctgcgaaaaatgtgtcctgctacatccagaatctccttcttggccaggagaagaaagtagaaatatccataccagcttcctccctcccaaggctgactccctggatagtggctgtggctgtcatcctgatggttctaggacttctcaccattgggtccatatttttcacttggagactatacaacgaaagacccagagagaggaggaatgaattcagctctaaagagagactcctggaagaactcaaatggaaaaaggctaccttgcatgcagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcacagtcattgctaatgcccaggacctttctaaggagatcccattgtcccccatgggggaggactctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctccctt

SEQ ID NO: 3859 - DNA, 1802 bp, Homo sapiens
cgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccccccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttcagggcctgacacttcacagagtggggacccaccagagcctatagaatcaattccttggtctcacagccatgtagacaagccctggtcatctcagcagccaccgcacaacacccatcttccagctgcctctttcacacccactacagacctcagccccagttttctcctcctcactaggctgtgtttttag

SEQ ID NO: 3860 - DNA, 2920 bp, Homo sapiens
actcttgggactgtggaagcccaggagaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtg

SEQ ID NO: 3861 - DNA, 3113 bp, Homo sapiens
cgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgagctccaattcttctcaaactgagagaactgcttctgtctctggagagacagaagtgcagcttcagtaattctcagtgtgtgagctgcctaggatcagagagccttcatggaagtggccactacgtggggatcccttcagagatatctgagacctctctggggatcaggaaccacacaatccccagggttcctgagaccccaggcctaaacctgagacttcctctgcagttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgccctcctcccctctggtcacacaagagaacatcttccagctgcctctttcacacccactacagacctcagccccagttttctcctcctcactaggctgtgtttttagtagttcctttgcttgtaactatgggatgggatccaggcatagggaactagttgttacacagctcccagccaagaagaaagtgtgagaagttgatgggcagcaaacctgctgtttaacatcagggtgaccacattaagcccagtattccagttggcaccagaagatatggacttggaatgaggcctacagggttcaccaggatgtaagaggagagaggaatccacaggaccaccagagaggagagggaaccagatatgcagatcagagatagaggaagtggaaccagagagctgggagggaccaaggttgtaagggtggctaagtcccaccataacagctaaggggacctgggagatgatggctcatttccacccagccccaggatttccagagcgcacatccacaggcctggacctgggatgaagatgaatgaagaacatggatgcacgtggatgtagtttggctcaggtgtccctgcagttggcaaggagtcagtactcagtccctgagtgtggctgaaatttgaggtcctggctgagccaaggagtaatggaccagatctacctcagtattcaagttcagtggggacaccagtggcttcaaacttcctggtttcatgatatcttgagacgccttacaaatgatggaggattccaaagagtttttgtttatttgggttaatatttgttggtatttatggcatttgagattgaaactaagaaatgttttaatttattacctttacaacatttatttacattacatacatacatttacaacatttattaatttatattaaaatagcatgaataagccaattataggttaatataagtagaatgtttgtgaaaaataagtatggtatccaaagcaaaataaattttattgtgaagtgtg

SEQ ID NO: 3862 - DNA, 1687 bp, Homo sapiens
tgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctcctcctcagcctgtgtgcactggtctcagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgggccagtttgaagctttatatatcatttaccaaacttagggtggtgagtgggtgctgatggcagcctggtttgaaaatctccactggagagaagacacagcaggattcagatgcaaatgaccagagcactccaagttggaaagaactgctgagcgggtctgtagagcccatcgctctctcctgtctattcatcagctaggctgaagctcctgacagactcacaccagtatcttgctgctccagaaaggtcgaagatggcagttttcccaaactccggcttgcccagatgtctgctcaccctcattcttctccagctgcccaagctggtttcagataggtctctctctctggcctgcagagttaaaacatctcaataaatataaagtataaaaagaagctggagcccaaccacttcggcacatgttcacaggatctcggggctgtgtcacaagccactgggcactcatatctggctgagaataaatctcttgcaatatttt

SEQ ID NO: 3863 - DNA, 1780 bp, Homo sapiens
agaccagatttcgtttcctgcatctccaaacatggcgacctaggagaaggggaagaacaattttttctcctcttttgggaaggtttgtgtctagtagtgcctgtgcccctgggcagattggagagaagagggacgactggagaatcgtcgagaaccagcggagaaaagaaaaagcaacgtttaattctagaagcccagtttattgtcgtggggcccactgatcccatcttggccacggttggagaaaacactacgttacgctgccatctgtcacccgagaaaaatgctgaggacatggaggtgcggtggttccggtctcagttctcccccgcagtgtttgtgtataaaggtggcagagagagaacagaggagcagatggaggagtaccgaggaagaaccacctttgtgagcaaagacatcagcaggggcagcgtggccctggtcatacacaacatcacagcccaggaaaacggcacctaccgctgttacttccaagaaggcaggtcctacgatgaggccatcctgcacctcgtagtggcaggactaggctctaagcccctcatttcaatgaggggccatgaagacgggggcatccggctggagtgcatatctagagggtggtacccaaagcccctcacagtgtggagggacccctacggtggggttgcgcctgccctgaaagaggtctccatgcctgatgcagacggcctcttcatggtcaccacggctgtgatcatcagagacaagtctgtgaggaacatgtcctgctctatcaacaacaccctgctcggccagaagaaagaaagtgtcatttttattccagaatcctttatgcccagtgtgtctccctgtgcagtggccctgcctatcattgtggttattctgatgatacccattgccgtatgcatctattggatcaacaaactccaaaaggaaaaaaagattctgtcaggggaaaaggagtttgaacgggaaacaagagaaattgctctaaaggaactggagaaagaacgtgtgcaaaaagaggaagaacttcaagtaaaagagaaacttcaagaagaattgcgatggagaagaacattcttacatgctgttgatgtggtcctggatccagacaccgctcatcccgatctcttcctgtcagaggaccggagaagtgtgagaaggtgccccttcaggcacctaggggagagcgtgcctgacaacccagagagattcgacagtcagccttgtgtcctaggccgggagagcttcgcttcagggaaacattactgggaggtggaggtggaaaacgtgattgagtggactgtgggggtctgtagagacagtgttgagaggaaaggggaggtcctgctgattcctcagaatggcttctggaccttggagatgcataaagggcaataccgggccgtgtcctcccctgataggattctccctttgaaggagtccctttgccgggtgggcgtcttcctggactatgaagctggagatgtctccttctacaacatgagggacagatcgcacatctacacatgtccccgttcagccttttccgtgcctgtgaggcccttcttcaggttggggtgtgaggacagccccatcttcatctgccctgcactcacaggagccaatggggtcacggtgcctgaagagggcctgacacttcacagagtggggacccaccagagcctatagaatcaattccttggtctcacagccatgtagacaagccctggtcatctcagcagccaccgcacaacacccctggtggaagacacgc

SEQ ID NO: 3864 - DNA, 3241 bp, Homo sapiens
aatcttgggactttttggacacccagagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaa

SEQ ID NO: 3865 - DNA, 3590 bp, Homo sapiens
aaatcttgggactttttggacacccagagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaa

SEQ ID NO: 3866 - DNA, 2733 bp, Homo sapiens
gggatgctttgttgtctggtggtgactgtgcccatgggtgagttgtatcggaaaatcgtcatgtgaggatcagaggggaaaagaaaacagaggttagttctagaaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcgcacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtga

SEQ ID NO: 3867 - DNA, 1790 bp, Homo sapiens
agtggaaatcttgggactttttggacacccagagaacaggtcccagataccgagtccgcaactccaaacatcgcgattaataggaggtgaacacagcttttctcttctctttgggatgctttgttgtctggtggtgactgtgcccatgggtgagttgtatcggaaaatcgtcatgtgaggatcagaggggaaaagaaaacagaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaa

SEQ ID NO: 3868 - DNA, 535 bp, Homo sapiens
agagaacaggtcccagataccgagtccgcaactccaaacatcgcgattaataggaggtgaacacagcttttctcttctctttgggatgctttgttgtctggtggtgactgtgcccatgggtgagttgtatcggaaaatcgtcatgtgaggatcagaggggaaaagaaaacagaggcctctggtctctgcctgccctgggtgctcatggaaccagctgctgctctgcacttctccctgccagcctccctcctcctcctcctgctcctcctccttctcagcctgtgtgcactggtctcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaaca

SEQ ID NO: 3869 - DNA, 942 bp, Homo sapiens
ctggtggggaggcgcagcctcgcctggctttacctcgagtgtcccgacctgggtctcggggagggggaagtggagggacgagggtgtgaaagaatccagggacaactgaagaaaccggactgtggcccgagaagtgggaagaggaaggaggaaaacggcccccttgatctctgcattgatggcttacttatggaatgtttacggaatccctctttcggagatacctgagccttgagatgcaagcgactcccagaagttggggcaccgatgagacctacttgagtgacaggagaggttgggcccgaccagcactgaggtgccaagactcctaggctgattctcctcctctgtaaccctaggcctctggtctctgcctgccctgggtgctcatggaaccagctgctgctctgcacttctccctgccagcctccctcctcctcctcctgctcctcctccttctcagcctgtgtgcactggtctcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaaga

SEQ ID NO: 3870 - DNA, 881 bp, Homo sapiens
tttttggacacccagagaacaggtcccagataccgagtccgcaactccaaacatcgcgattaataggaggtgaacacagcttttctcttctctttgggatgctttgttgtctggtggtgactgtgcccatgggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttat

SEQ ID NO: 3871 - DNA, 540 bp, Homo sapiens
gttgtctggtggtgactgtgcccatgggtgagttgtatcggaaaatcgtcatgtgaggatcagaggggaaaagaaaacagagatacctgagccttgagatgcaagcgactcccagaagttggggcaccgatgagacctacttgagtgacaggagaggttgggcccgaccagcactgaggtgccaagactcctaggctgattctcctcctctgtaaccctaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtacc

SEQ ID NO: 3872 - DNA, 3434 bp, Homo sapiens
aatcaaaaaacttattcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacgcactgaagcactttactgatactcattcaattattcatatgacagttgtttgagtttggtaccatcttattttccccttatacagataaggaaactggggtgcagaaaagtgaattgactacaaagtagacatgactagttaacaacacagctgggatctaaacagcaataactaacattaatggagaacttaaaatgctctgagtgctgtgttatgagctttggtggatgtcactcctttaatcctcgcaacaccctgtcgggtagtctcatttagcaagtatggaagttgaggcagggcaacattaagcaacttacataactcatgcagtaatttctgcagttgggagatgttcagcttcagtccccggccctatggccgttcttttccaccctgtttcttcccccataggaagaacccacctgtagccctgaggttcttttcccaggatggctccaggataaggatcactgtaggtggttgtggagttgacacccctgttgactccttcccagctgattgtcagagccttagacccagcacgccttggattagctctgcagagtgtcttggttgagagaataacctcaccgtacccacatgacacgtgatttggaaagagactagaggccacacttgataaatcatggggaacagatgtgttccacccaacaaatgtgataagtgatcatgcagccagagccagccttccttcaatcaaggtttccaggcagagcaaataccctagagattctctgtgatataggaaatttggatgaagggagctagaagaaatacagggatttttttttttttttaagatggagtcttactctgttgctaggctggagtgcagtggtgcgatctcagctccctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccggcttacagggatatttttaatcccgttatggactctgtctccaggagaggggtctatccacccctgctcattggtggatgttaaaccaatattcctttcaactgctgcctgctagggaaaaactactcctcattatcatcattattattgctctccactgtatcccctctacctggcatgtgcttgtcaagttctagttgttcaataaatttgttaataatgctgactcttcaa

SEQ ID NO: 3873 - DNA, 2077 bp, Homo sapiens
agtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacgcactgaagcactttactgatactcattcaattattcatatgacagttgtttgagtttggtaccatcttattttccccttatacagataaggaaactggggtgcagaaaagtgaattgactacaaagtagacatgactagttaacaacacagctgggatctaaacagcaataactaacattaatggag

SEQ ID NO: 3874 - DNA, 1882 bp, Homo sapiens
attcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgggcctcccattggccaaacccaacagcaaaccagaggacaagggagcccagtggcactgtctcaggaatctgcccagaggacagattcctggggcccagaagagggtggagaaagctgaagggtggagagtgaatctagggcatataaggcaccacatagagcccagcacagagacggccttgcagctatcaggaagatgaggagcttccttcatggcctgctgtgggctgagtaaataacatgattgccttctacagcgctagagattcatttgtttatccccatttttcaggtgaggaaatgcttcagatgaggctccactttgttaaataaattggatgtatggaaaaatagactgcagaaaaggggaactcatttagctcatgagtggtcgaatgaaggttgaaaattaacctctgagtataaagcattagtgggcagagtgaatatggggagggaaacaagaaaaacgtagaaaggatccttgctgcttcctgaggccgcgtca

SEQ ID NO: 3875 - DNA, 570 bp, Homo sapiens
aaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagagatcttgttctcagaggccattcccagacccacagcaagagggattatggctgcaggcctcatgctcctttgttttggaagaaactgttgaggagtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatgg

SEQ ID NO: 3876 - DNA, 580 bp, Homo sapiens
attcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctct

SEQ ID NO: 3877 - DNA, 1758 bp, Homo sapiens
aatcaaaaaacttattcttccaaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctggtgaggaaatgcttcagatgaggctccactttgttaaataaattggatgtatggaaaaatagactgcagaaaaggggaactcatttagctcatgagtggtcgaatgaaggttgaaaattaacctctgagtataaagcattagtgggcagagtgaatatggggagggaaacaagaaaaacgtagaaaggatccttgctgcttcctgaggccgcgtcagggtattgggttaggcagagatgctgaggcaaccctcatttcaccctcctcttcccctctggacacaagatacctgatacctggggctttctctcctgacatcgatgagagagtcacatttagggcagactagggacaccaggctttggactcagacctcctcagcatggcccaggccttgcatgctgaggctctgaaatccaggaaaaatggttgacctcatggacacttcctcaaactctctgcagcggatgtgattctggatccaaaaacagcaaaccccatcctccttgtttctgaggaccagaggagtgtgcagcgtgcca

SEQ ID NO: 3878 - DNA, 619 bp, Homo sapiens
attcctcacgatgacccgacagtctctgctttctttttcctttcttccagaaggagatttaaccatagtagaaagaatggagaactattaactgcctttcttctgtgggctgtgattttcagaggggaatgctaagagacatgtttttacaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcacc

SEQ ID NO: 3879 - DNA, 3017 bp, Homo sapiens
atttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctgactcttc

SEQ ID NO: 3880 - DNA, 1634 bp, Homo sapiens
gaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaa

SEQ ID NO: 3881 - DNA, 1225 bp, Homo sapiens
cctttcttccggatgagaggctaagccataatagaaagaatggagaattattgattgaccgtctttattctgtgggctctgattctccaatgggaataccaagggctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcact

SEQ ID NO: 3882 - DNA, 1494 bp, Homo sapiens
ggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatg

SEQ ID NO: 3883 - DNA, 1512 bp, Homo sapiens
ataatagaaagaatggagaattattgattgaccgtctttattctgtgggctctgattctccaatgggaataccaagggatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaag

SEQ ID NO: 3884 - DNA, 1460 bp, Homo sapiens
atttgctttctctttttcctttcttccggatgagaggctaagccataatagaaagaatggagaattattgattgaccgtctttattctgtgggctctgattctccaatgggaataccaagggatattatttttacagatggttttccatactggaacccaaaggtaaagacactcaaggacagacatttttggcagagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagt

SEQ ID NO: 3885 - DNA, 1149 bp, Homo sapiens
tatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaatccagtacttga

SEQ ID NO: 3886 - DNA, 3002 bp, Homo sapiens
aatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgctta

SEQ ID NO: 3887 - DNA, 2930 bp, Homo sapiens
aatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgctt

SEQ ID NO: 3888 - DNA, 671 bp, Homo sapiens
aatcaaaaaactaattcttccaaaaagagattgttattattcctcacaataaccagatagcctctgctttctttttcctttcttcggaatgagagactcaaccataatagaaagaatggagaactattaaccaccattcttcagtgggctgtgattttcagaggggaatactaagaaatattatttttacagatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccct

SEQ ID NO: 3889 - DNA, 1002 bp, Homo sapiens
agagattgttattattcctcacaataaccagatagcctctgctttctttttcctttcttcggaatgagagactcaaccataatagaaagaatggagaactattaaccaccattcttcagtgggctgtgattttcagaggggaatactaagaagtaagtggggaatgttgattagagcctgggctacaatgcctgggaggacaagagctgaatcgctgagagtgatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgc

SEQ ID NO: 3890 - DNA, 1368 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3891 - DNA, 1167 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcagagaagctgctggccgttctgtcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctga

SEQ ID NO: 3892 - DNA, 738 bp, Homo sapiens
atggtggattttccaggctacaatctgtctggtgcagtcgcctccttcctattcatcctgctgacaatgaagcagtcagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3893 - DNA, 333 bp, Homo sapiens
agggaggatggtggattttccaggctacaatctgtctggtgcagtcgcctccttcctattcatcctgctgacaatgaagcagtcagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaa

SEQ ID NO: 3894 - DNA, 784 bp, Homo sapiens
agggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagatgaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctgggtaagtacgaggtgctggcacacacctgtggagggagcctctgccct

SEQ ID NO: 3895 - DNA, 784 bp, Homo sapiens
agggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctgggtaagtacgaggtgctggcacacacctgtggagggagcctctgccct

SEQ ID NO: 3896 - DNA, 688 bp, Homo sapiens
aaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacatttttgtggaaaacactgcttgtttggggattgcttcttgctgtggctgtaggcctgcccaggaagaggagctgaaaagaggtaagttctctggacattttttctgtacccacaagaacatctccaa

SEQ ID NO: 3897 - DNA, 784 bp, Homo sapiens; identical to SEQ ID NO: 3895

SEQ ID NO: 3898 - DNA, 333 bp, Homo sapiens; identical to SEQ ID NO: 3893

SEQ ID NO: 3899 - DNA, 333 bp, Homo sapiens; identical to SEQ ID NO: 3893

SEQ ID NO: 3900 - DNA, 688 bp, Homo sapiens
aaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctgaaaagaggtaagttctctggacattttttctgtacccacaagaacatctccaa

SEQ ID NO: 3901 - DNA, 1085 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcagctgttcttagagatgacattattgcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3902 - DNA, 333 bp, Homo sapiens; identical to SEQ ID NO: 3893

SEQ ID NO: 3903 - DNA, 784 bp, Homo sapiens; identical to SEQ ID NO: 3894

SEQ ID NO: 3904 - DNA, 333 bp, Homo sapiens; identical to SEQ ID NO: 3893

SEQ ID NO: 3905 - DNA, 688 bp, Homo sapiens; identical to SEQ ID NO: 3900

SEQ ID NO: 3906 - DNA, 784 bp, Homo sapiens; identical to SEQ ID NO: 3894

SEQ ID NO: 3907 - DNA, 784 bp, Homo sapiens; identical to SEQ ID NO: 3895

SEQ ID NO: 3908 - DNA, 333 bp, Homo sapiens; identical to SEQ ID NO: 3893

SEQ ID NO: 3909 - DNA, 784 bp, Homo sapiens; identical to SEQ ID NO: 3895

SEQ ID NO: 3910 - DNA, 688 bp, Homo sapiens; identical to SEQ ID NO: 3900

SEQ ID NO: 3911 - DNA, 688 bp, Homo sapiens
aaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctgaaaagaggtaagttctctggacattttttctgtacccacaagaacatctccaa

SEQ ID NO: 3912 - DNA, 688 bp, Homo sapiens; identical to SEQ ID NO: 3911

SEQ ID NO: 3913 - DNA, 333 bp, Homo sapiens; identical to SEQ ID NO: 3893

SEQ ID NO: 3914 - DNA, 688 bp, Homo sapiens; identical to SEQ ID NO: 3911

SEQ ID NO: 3915 - DNA, 3182 bp, Homo sapiens
gtccccggagtttcactgttgagaggattatagctgttaggaggtgaatgtgctattctgattttcagaatgcaatctcattttcacagggcctccgggatttggctctgccttcaactggggtgagacggcttaaatcctccttcacccaaagtcctggaggaggcctccacactctctggctctcccacagttctgtctttgatcagcacaccccagggctctgacctgtttctgaccacctgctatgtggatgaagatacatctggggctaaggaggatggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagataaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctgaaaagaggttctctggacattttttctgtacccacaagaacatctccaacgtatcaggaaaataacaatctgggattctggaaaccagaatgatattctgagtcctgatcatttctcatttctctaactgcttgaagggggctgccatgatcattgaagtactaactcaaggtgttttaattctactcaggaaaatctgctggagactgatcttttcagagacctatcctgttccaggttctctgagatccggcctatcaatcacaatctgacatctgataatcaaggacccttagaaaatcccatgggaaatacaatttagcctacaggaagaaatgaaaggaataatcaaggatttggtcagtttctttttttttttttttttcttttctttttttttttttttttttttttctgagacaaagtctcactctgtcacccaggctggagtgcagtggcatgatctcagctgactgcaacctctgcctcccgggttcaagcaattctcttgcctcagtctcatgagtagctgggattacaggcatgtgccaccatgcccagcctatttttgtatttttagtagagatggggtttcactttgttggccaggctggtctcaaacttctggcctcaaatgatccactcgcctcggcctcccaaagtgctggaattacaggcatgagccaccacacctggcctgatcagtttatttaagatggtgacaattaattgtccacataggtggaactgagaaaataaaaaatatatatatacagttaaaaaaaagtgaaagaaaatacagctgcataagggggagaaaaatctgatcactaaaatataatcttgaaaatcttatgaagtgttgtaaaatccctcctccagactttttgagaaagttgatacaggaaattgagtcaggaaaaaaattttacactttccgatccaagcgaaaaattatgtatcatctatacgaacatgtcaattttattgttagagcaaaataaagtgcacaatttaaaattaataattataaaataaacaaatataagcagtacatgtaacacagtaaaaatattttaaagttataatgagttcaagaagataaactatatgtggaagacagaagaatgtcaacaagacttttggaaagaatgttatgaagtgagaagacgaggacctgctagtgacgctctgctgctctccaggatggcagacgtcagaggcatcgcggtcccatgcggatcactcatgaacagcactctgaacttgctcttctgggccatcatttttttttctatttttaaactcataaatttaaacacataaatgttagaaactacacattattcttccacaaatgtttacacattaattttaataaacatttttttcaattgtggtaaaatacataacataaaataaaaccctttaaccattttaaagtgtacagttct

SEQ ID NO: 3916 - DNA, 738 bp, Homo sapiens
atggtggattttccaggctacaatctgtctggtgcagtcgcctccttcctattcatcctgctgacaatgaagcagtcagacaggctggacaccccaaaagcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3917 - DNA, 845 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3918 - DNA, 1167 bp, Homo sapiens; identical to SEQ ID NO: 3891

SEQ ID NO: 3919 - DNA, 1167 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcagagaagctgctggccgttctgtcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacgtttttgtggaaaacactgcttgtttggggattgcttcttgctgtggctgtaggcctgcccaggaagaggagctga

SEQ ID NO: 3920 - DNA, 1167 bp, Homo sapiens; identical to SEQ ID NO: 3891

SEQ ID NO: 3921 - DNA, 738 bp, Homo sapiens
atggtggattttccaggctacaatctgtctggtgcagtcgcctccttcctattcatcctgctgacaatgaagcagtcagacaggctggacaccccaaaagcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3922 - DNA, 738 bp, Homo sapiens; identical to SEQ ID NO: 3916

SEQ ID NO: 3923 - DNA, 1167 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcagagaagctgctggccgttctgtcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtactggtgagtgacgccattgacgagggcagactgaccctgcagatactcagtgccagaccttcggacgacgggcagtaccgctgcctttttgaaaaagatgatgtctaccaggaggccagtttggatctgaaggtggtaagtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcagagtccaggatgacatttttgtggaaaacactgcttgtttggggattgcttcttgctgtggctgtaggcctgcccaggaagaggagctga

SEQ ID NO: 3924 - DNA, 1085 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcagctgttcttagagatgacattattgcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3925 - DNA, 738 bp, Homo sapiens
atggtggattttccaggctacaatctgtctggtgcagtcgcctccttcctattcatcctgctgacaatgaagcagtcagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3926 - DNA, 845 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3927 - DNA, 738 bp, Homo sapiens; identical to SEQ ID NO: 3916

SEQ ID NO: 3928 - DNA, 1368 bp, Homo sapiens
atggtggattttccaggctacaatctgtctggtgcagtcgcctccttcctattcatcctgctgacaatgaagcagtcagaagactttagagtcattggccctgctcatcctatcctggccggggttggggaagatgccctgttaacctgccagctactccccaagaggaccacaatgcacgtggaggtgaggtggtaccgctcagagcccagcacacctgtgtttgtgcacagggatggagtggaggtgactgagatgcagatggaggagtacagaggctgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtctggggtctgcccctagcatccacatggagggacctggggagagtggagtccagcttgtgtgcactgcaaggggctggttcccagagccccaggtgtattgggaagacatccggggagagaagctgctggccgtgtctgagcatcgcatccaagatgaagatggcctgttctatgcggaagccaccctggtggtcaggaacgcctctgcagagtctgtgtcctgcttggtccacaaccccgtcctcactgaggagaaggggtcggtcatcagcctcccagagaaactccagactgagctggcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtgctggtgagtgacgccattgacgagggcagactgaccctgcagatactcagtgccagaccttcggacgacgggcagtaccgctgcctttttgaaaaagatgatgtctaccaagaggccagtttggatctgaaggtggtaggtctgggttcttccccactgatcactgtggaggggcaagaagatggagaaatgcagccgatgtgctcttcagatgggtggttcccacagccccacgtgccatggagggacatggaaggaaagacgataccatcatcttcccaggccctgactcaaggcagccacgggctgttccacgtgcagacattgctaagggtcacaaacatctccgctgtggacgtcacttgttccatcagcatcccctttttgggcgaggagaaaatcgcaactttttctctctcaggttggtga

SEQ ID NO: 3929 - DNA, 1085 bp, Homo sapiens; identical to SEQ ID NO: 3901

SEQ ID NO: 3930 - DNA, 1085 bp, Homo sapiens; identical to SEQ ID NO: 3924

SEQ ID NO: 3931 - DNA, 738 bp, Homo sapiens; identical to SEQ ID NO: 3916

SEQ ID NO: 3932 - DNA, 1085 bp, Homo sapiens; identical to SEQ ID NO: 3901

SEQ ID NO: 3933 - DNA, 738 bp, Homo sapiens; identical to SEQ ID NO: 3921

SEQ ID NO: 3934 - DNA, 738 bp, Homo sapiens; identical to SEQ ID NO: 3916

SEQ ID NO: 3935 - DNA, 1368 bp, Homo sapiens; identical to SEQ ID NO: 3890

SEQ ID NO: 3936 - DNA, 1368 bp, Homo sapiens; identical to SEQ ID NO: 3890

SEQ ID NO: 3937 - DNA, 845 bp, Homo sapiens; identical to SEQ ID NO: 3917

SEQ ID NO: 3938 - DNA, 1368 bp, Homo sapiens; identical to SEQ ID NO: 3890

SEQ ID NO: 3939 - DNA, 1085 bp, Homo sapiens; identical to SEQ ID NO: 3901

SEQ ID NO: 3940 - DNA, 1368 bp, Homo sapiens; identical to SEQ ID NO: 3928

SEQ ID NO: 3941 - DNA, 1368 bp, Homo sapiens; identical to SEQ ID NO: 3928

SEQ ID NO: 3942 - DNA, 1085 bp, Homo sapiens; identical to SEQ ID NO: 3924

SEQ ID NO: 3943 - DNA, 845 bp, Homo sapiens; identical to SEQ ID NO: 3926

SEQ ID NO: 3944 - DNA, 738 bp, Homo sapiens; identical to SEQ ID NO: 3925

SEQ ID NO: 3945 - DNA, 738 bp, Homo sapiens; identical to SEQ ID NO: 3892

SEQ ID NO: 3946 - DNA, 1167 bp, Homo sapiens; identical to SEQ ID NO: 3891

SEQ ID NO: 3947 - DNA, 1368 bp, Homo sapiens; identical to SEQ ID NO: 3890

SEQ ID NO: 3948 - DNA, 1167 bp, Homo sapiens; identical to SEQ ID NO: 3919

SEQ ID NO: 3949 - DNA, 738 bp, Homo sapiens; identical to SEQ ID NO: 3921

SEQ ID NO: 3950 - DNA, 1085 bp, Homo sapiens; identical to SEQ ID NO: 3901

SEQ ID NO: 3951 - DNA, 1167 bp, Homo sapiens; identical to SEQ ID NO: 3919

SEQ ID NO: 3952 - DNA, 2440 bp, Homo sapiens
catactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggagagacgtttttccagccctcaccttggcgcctggcttctattttactcgggttactctgtggtgccctgtgtggtgttgtcatggggatgataattgttttcttcaaatccaaagggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccata

SEQ ID NO: 3953 - DNA, 2266 bp, Homo sapiens
ttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcagcactgggctcacttcctctcatttccatcgtgggatatgttgacggaggtatccagttactctgcctgtcctcagtccagccctcaccttggcgcctggcttctattttactcgggttactctgtggtgccctgtgtggtgttgtcatggggatgataattgttttcttcaaatccaaagggaaaatccaggcggaactgggtatgtgtcatgtcctgagcctcccacacatggttctcccgggtccctccctgatccacagtttgagcctctggacgaccctggctgcaggctggacaggaagcaccgactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagt

SEQ ID NO: 3954 - DNA, 2454 bp, Homo sapiens
gagctttgtcagtaacagttgattgttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatca

SEQ ID NO: 3955 - DNA, 702 bp, Homo sapiens
gcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaa

SEQ ID NO: 3956 - DNA, 697 bp, Homo sapiens
gcagtccaatttacaggctggagcagcagctgcatcctgcatttccccgaagtattacatgattttcactccttgcaaactttgccatctttgttgcagagaatcgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccc

SEQ ID NO: 3957 - DNA, 2029 bp, Homo sapiens
tctcggcacccctcggtgacgcctccactgacatcatctgcggattcccgccccgaggtttctaaatccagacattcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaa

SEQ ID NO: 3958 - DNA, 2233 bp, Homo sapiens
gggagactggagtcgaaggccgtgaggtatttttctaagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttgtataactgacctgtgtatttttatcttttgagtaaatttgccttccaaattaggaagataggttttagaagtcatcacaaatagagaaattcttgagtttttgttcctgatgcatggtgtccacagttcttttcatctcattttttttcagattttttttatttcatgtttttgaggctgtatcaagtacatacaagtgttttggaacaacttcttaagttacctaatgccacttaagcagatgagaagtccaaaggagattacactgtgtttgtattgtggtttatttttctggaatattagttacagagagtactacatagtaaacctttttttaaatgtctaagcccatgaattttaattatatgcccttaatgctttcagtgtttgaatccatatcattatgtgtaggaatgccaagtatagtaaagtactttaatttttgaaaaaggagttgttaaaattttctgtgtgattaattctccataagtaaccttgaataaatggatttcttgatttatgatagcagatattggaaatggtcttaaaatgtaatggattttgtaaagcatgttgaactctttctatgacacatgaagaggaagtcactgatagacgcagaaggtcttttctgtctctgatgtcagtttttgaagtggaagaacattagtgaacatttatagttattttactcctttttttgcctttgtctccaaatttctagctatttttaaaaataacctcttcatgagagaaatgtgttactgttaagatcaagtgtagtgtacctgtctttgtgttatttattgcaaagaaatttatttggatttctgtatattttctaatttcataaaagaaaaacagcttaaatgaaaaatgttatacaattgcagaaaatcattattggttttagctaagttattggtttatgaaagtgcacctctacgttctgttaaattgtgtaacttttaagtgagtaattctttcattattaggtagaaataaaagtttgagtatattccattttattatgtataattttaaatacttagcacgtaataaggagctgaatggctgta

SEQ ID NO: 3959 - DNA, 1379 bp, Homo sapiens
ggagactggagtcgaaggccgtgaggtatttttctaagtgagaggaaggactgagtggcagtaacatctgttagggttactgggcagcatccccgcaacccaggtactcagtctcagccacaccttactgagtggtgaagagaagcaagttttctcatgccctctccgtctgtctctacctctgcagccagtgttttagaaggagtatgtggaagggcaaggagtacctatagaaccccggaggagggtgaggagcagagctggtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctcttgatgagactcttatttctttatataggtcagtcttgcaagtaccattttataagcagctgtgaaatttaagtgaaatgttctttgtaaacatttgtactattttaaatgaataatgaccttatgaagtatgctatctgtaggctgaaattataggtacatctgttttcactatatgatattaagaaagcgtgaaatgacttaaatgttcatttttttctgtatagatactttatcatgttttcatgattttaggaattactgctttgttgatattcaaagtgtgaaactaaaactttatggttgtactttaattcttggcatgttgcctctatgtcccatttaaaataaaatacattctcattaactttagatgggaaataaggttgtatgttgatggatgaattttggcatgatgactgtactctcaataaaggctgaaaatgttg

SEQ ID NO: 3960 - DNA, 772 bp, Homo sapiens
tcgtcatcgttgcccgaccgctttccgggagactggagtcgaaggccgtgagccagtgttttagaaggagtatgtggaagggcaaggagtacctatagaaccccggaggagggtgaggagcagagctggccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatat

SEQ ID NO: 3961 - DNA, 736 bp, Homo sapiens
agccggcgcgtcattgtcgtcatcgttgcccgaccgctttccgggagactggagtcgaaggccgtgagtcagccataatggcaggtgaagaaattaatgaagactatccagtagaaattcacgagtatttgtcagcgtttgagaattccattggtgctgtggatgagatgctgaagaccatgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaatcgaaaaatgcatcaaaagttgccaataaaggaaaaagtaaaagttaactttttggttttgatgtacacatattcaaaaagtacatcttcccccccccccccccccccgcaaaataattctgtggcagggcaaggtttaaatgtgtttcttattaatatgtaaattcacagtaaatatgtaaagctaaatactttcctctccaaagatcattatctttattgattagcactgaggattttaacattgtgatatattatatatttataatttaccatctctt

SEQ ID NO: 3962 - DNA, 1613 bp, Homo sapiens
cgcgggcgggcaaacggacggctccgcccagccgccggctcctttaccccgccccactacccccgccttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtg

SEQ ID NO: 3963 - DNA, 1492 bp, Homo sapiens
gtaacggagtggtgcgccaacgtgagaggaaacccgtgcgcggctgcgctttcctgtccccaagccgttctagacgcggatgaagtgcaaaacaaacttctccatagaggagttgttgcaaagttccagtttataccaaacagtaatcagattccattggaagctaaagattttgagagccttttgtactatatgcaactaacttgatttcaagcttgggaaccttttaaaaaaaacattaaaagcaaaatgaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaa

SEQ ID NO: 3964 - DNA, 3917 bp, Homo sapiens
actctaccaaggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctcagatgtcatcctctgcatggaggcaacagaatcgagcaagaccgagttctgcaatcctgccttcgagcctgagtctgggccaccctgccctcccccagttttcccagaggatgccagctacagcgtcccagctccctggcatggtcggcgtcctcgagggctacggccagactgccgcttctcctggctctgtgtcctcctgctctccagcctgctcctcctgctgcttgggctgctggtggccatcatcctggcccagctgcaggctgcacccccatctggggcgtcccatagcccactgcctgccggaggccttaccacgaccaccaccacccccaccatcaccacctctcaggcagctgggacccctaaagggcagcaggagtcaggcgtgagcccctccccacagtccacctgtggaggcctcctctctggcccaaggggcttcttcagcagccctaactacccagacccttacccccccaacacccactgcgtgtggcatatccaggtggccacagaccatgcaatacagctcaagatcgaagccctcagcatagagagtgtggcctcttgcctttttgatcgcttggaactctcccctgagcctgaaggccccctcctcagggtttgtggaagggtgcctccccccacgctcaacaccaatgccagccacctcctggtggtcttcgtctctgacagcagtgtggaaggatttggtttccatgcctggtaccaggctatggcccctgggcgcgggagctgtgcccatgatgagttccgctgtgaccagctcatctgcctgctacctgactcagtgtgtgatggttttgccaactgtgctgacggcagtgatgagaccaattgcagtgccaagttctcggggtgtggggggaatctgactggcctccagggcactttctctactcccagctacctgcagcagtaccctcaccaactgctctgcacctggcatatctcggtgcctgccggacacagcatagaactacagttccacaacttcagcctggaggctcaggacgagtgcaagtttgactacgtggaggtgtatgagaccagcagctcaggggccttcagcctcctgggcaggttctgtggagcagagccacccccccacctcgtctcctcgcaccatgagctggctgtgctgtttaggacagatcatggcatcagcagtggaggcttctcagccacctacctggccttcaatgccacggagaacccctgtgggcccagtgagctctcctgccaggcaggagggtgtaagggtgtgcagtggatgtgtgacatgtggagagactgcaccgatggcagcgatgacaactgcagcggccccttgttcccacccccagagctggcctgtgagcctgtccaggtggagatgtgcctcggtctgagctacaacaccacagccttccctaacatctgggtgggcatgatcacccaggaggaggtggtagaggtcctcagcggttacaagagcctgacaagcctgccctgctaccagcatttccggaggctcctgtgtgggctgcttgtgccccgttgcaccccactaggcagtgttctgcccccttgccgctctgtctgccaggaagcggagcaccagtgccagtctggcctggcactactgggcaccccctggcccttcaactgcaacaggctgccagaggcagctgacctggaagcttgtgcccagccctgaccctgaagccggcccctgccctcttcctgcccgtcctcttttgccggtcagggctggcacgcaggggaacaaaggaaggagcatcagcagggtctctacccatccttctctggggctcccagggagggggaagagaagtcctcagctggggctcatgggaccctaccaccctccctgctccttcctgtccctttaccggtcccaggctgctgactggccccacactgtgccaccggacaatcgagaccacttcccatccaggcctcttcccctttccatctgctttttcagcttctccatcgcctgccttctgaccttttccttgattcaacaaaaatgtactgagcatctattcatgtggcaggcccctgtcctaggccctagggatccaactggctgtctgcctctagaactctccaccctcatctctctgcgtatttctccctgaaatggggtctggtccttggtctctgccactgccctgcctctcctctggccctgggaacaggaggtgccctgtgtgtccgtctctcgaagttctgcctctctgtgcccagctcaagtctctctccccctcctttctccccctaaactttggccggccgccgggcgacaccacgagttatttcccagctatttcccggtccgggagctcttggcccctgaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctc

SEQ ID NO: 3965 - DNA, 1353 bp, Homo sapiens
gaacaactggtttcctcttggagtctgggaggaggaaagcggagccggcagggagcgaaccaggactggggtgacggcagggcagggggcgcctggccggggagaagcgcgggggctggagcaccaccaactggagggtccggagtagcgagcgccccgaaggaggccatcggggagccgggaggggggactgcgagaggaccccggcgtccgggctcccggtgccagcgctatgaggccactcctcgtcctgctgctcctgggcctggcggccggctcgcccccactggacgacaacaagatccccagcctctgcccggggcaccccggccttccaggcacgccgggccaccatggcagccagggcttgccgggccgcgatggccgcgacggccgcgacggcgcgcccggggctccgggagagaaaggcgagggcgggaggccgggactgccgggacctcgaggggaccccgggccgcgaggagaggcgggacccgcggggcccaccgggcctgccggggagtgctcggtgcctccgcgatccgccttcagcgccaagcgctccgagagccgggtgcctccgccgtctgacgcacccttgcccttcgaccgcgtgctggtgaacgagcagggacattacgacgccgtcaccggcaagttcacctgccaggtgcctggggtctactacttcgccgtccatgccaccgtctaccgggccagcctgcagtttgatctggtgaagaatggcgaatccattgcctctttcttccagtttttcggggggtggcccaagccagcctcgctctcggggggggccatggtgaggctggagcctgaggaccaagtgtgggtgcaggtgggtgtgggtgactacattggcatctatgccagcatcaagacagacagcaccttctccggatttctggtgtactccgactggcacagctccccagtctttgcttagtgcccactgcaaagtgagctcatgctctcactcctagaaggagggtgtgaggctgacaaccaggtcatccaggagggctggcccccctggaatattgtgaatgactagggaggtggggtagagcactctccgtcctgctgctggcaaggaatgggaacagtggctgtctgcgatcaggtctggcagcatggggcagtggctggatttctgcccaagaccagaggagtgtgctgtgctggcaagtgtaagtcccccagttgctctggtccaggagcccacggtggggtgctctcttcctggtcctctgcttctctggatcctccccaccccctcctgctcctggggccggcccttttctcagagatcactcaataaacctaagaaccctc

SEQ ID NO: 3966 - DNA, 3406 bp, Homo sapiens
gcccagaggaagccacgggcgcccaggcgggcatgaaagggctctttgacggctgggttgctgggacagtaacacagacggccggccaggaggaaggaccttgccctgtgctacaatcccagagggcttcctgaaggaggcagcctagatctttgtccagcagagcccatcttcagggaatattgaggatcccgacccgtgcacctgccctagcggaagacactcctggccaagcctccagatgtggctgtgaggggagtgggccctggccaagatggcagcccccgccctgctgctcctagcactgctgctgcccgtgggggcctggcccgggctgcccaggaggccctgtgtgcactgctgccgcccggcctggccccctggaccctatgcccgggtgagtgacagggacctgtggaggggggacctgtggagggggctgcctcgagtacggcccactatagacatcgaaatcctcaaaggtgagaagggtgaggccggcgtccgaggtcgggccggcaggagcgggaaagaggggccgccaggcgcccggggcctgcagggccgcagaggccagaaggggcaggtggggccgccgggcgccgcgtgccgacgtgcctacgccgccttctccgtgggccggcgcgagggcctgcacagctccgaccacttccaggcggtgcccttcgacacggagctggtgaacctggacggcgccttcgacctggccgcgggccgcttcctctgcacggtgcccggcgtctacttcctcagcctcaacgtgcacacctggaactacaaggagacctacctgcacatcatgctgaaccggcggcccgcggccgtgctctacgcgcagcccagcgagcgcagcgtcatgcaggcccagagcctgatgctgctgctggcggcgggcgacgccgtctgggtgcgcatgttccagcgcgaccgggacaacgccatctacggcgagcacggagacctctacatcaccttcagcggccacctggtcaagccggccgccgagctgtagccggacagacgtccgcctgtggggactctgggagccccggctggcgcgcccgcctctccacttcgcctcactcctgtcctgggacagagggtgccctgcccttgggagatggtgctctgaggcccggccagagtctgcagaacccgcgtgtgtgtgctggagccactccccaggcaggcgggggaacaagcgtggcccccaacagcgcaggacaggaggaggggcggctacaggggcccgccatttgctgtgcacacatggcccctctgcagggagaggggctctgtcccggctgcgccacccccacccactgcccaagcctgctgcctcccaagtcgcccggcatccacctctttccctgaggctgtccctggggccaggctgcccctcagcacccccaagtggccccgtactcaagtcccaccttgtgtgtctgtgggggggcggtagcagggcttctggaagtgtggtgacaaccaaggacaggaggggctggggccggtggccgtggctggtgaaccctggccctgctagagacaggaggggcactggcgctggggctggacccggaaccttccctctccttcgccccacactgaggtgggcggggcctcaggctgcactttggcccagggcctgagtctgctcctggctgggatagcgggacacacccagggcgcccggcaaccggcaggggtcggagccatctccgggcactcacggggccttggcacagaggcttccgccttagagagaaaggcgcccgaacaggaaggggtgggccgaggggagattggcagaccccaggcctcccaccccgaccgggacacccccagccctaccccgtgtgctgacggccggtggcgctaagaggtgccaggagagaagcccacagcctggtcctggctgcagcagcagggcgcctggtcagcactctggggagccttgtgctcactcagcccgttcccaagtgaggacacccagtgccacgcaggcagagccaggctgcagccacgtcccgcccaccccacacagagcccgtgtccctgccagctctgcctgtcgcctcagcttcccgtgcagcagggggtgcgcaaaggcctctgtcggggaccccagagcagctgtgaggggccctgggcttgcaggtcccaagtgggcactgcccagagccgagcccttggtgtccaggccccggaggacagctgcacggctccaggggttcctgcttggggggatccccaggaggagcctgttggggtcaagtgtggcaggtgcttgaagaaccagaggtggggggtatgggctgctgggggtgggggtcccggctggccatgcagaggttcttggccccggtgagagagcagggctggatgggagatgggagccaggggtccggaccaccccagggccagggaggacatctcctctcgcaggctgcctgttctgtgctggggaagcaccccagaatcccagacaaccgttcctttccctggccctggccctggcccggctgccctggggtctccagcctctgtgattccagtgagcctgtgctgccagggtggcaggtggtcctgaggaagagagtcccgggaagacgccagcccctgcaccagggagctcagaaagtgcccgtcaccaggcccagccaaggacccagacgtgaccacagcagccccgaagccaggcgcttattccgagggacaggctggacctccccgcacagacgtcgccgtggcctataggtagttgcagctgcggatactaagaagcagcaggggtcaggcgggcaggggtcgggctgcagcaggggtcaggcgggcaggggtgcaaggtctcttggaagctggcgggggtgtctaatgaatgccagtggcgaccctggttctcagagaaccggggtggggagatgcctgtgagagcctcagacagcaggacctgcatcccgccaaccttccaggtttatttgtttaaaaaacaatgactgagaactgaaagtgagataagatacggtcacgattctctgccaagtgataaaagcctgagggacgctgccagtgccaggtgggagcggaaagagggatgcttggtagaggccagagacacgaaaagcagcgacagcctcgtgctgccctggccacttaggagacaagggggagccaccccatcagaaccgcaccgggcacccccgtggtcggcccgtgctggctttaatcatgagtcaaccgcacaggaagggactggggaacgcggcttcccgcggggacatccctgtgacattccaggcaagcatcgggctggggaggcagcttatcccatgtaactttatccgtttagtggaattccagtaaaaatccaattttaaatgtt

SEQ ID NO: 3967 - DNA, 1830 bp, Homo sapiens
gcacagtatctgggtccagcctgcagccctagggtccagttcagagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggacgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaagggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaaaggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatatgcccattaaatttgataagatcctgtataacgaattcaaccattatgatacagcagcggggaaattcacgtgccacattgctggggtctattacttcacctaccacatcactgttttctccagaaatgttcaggtgtctttggtcaaaaatggagtaaaaatactgcacaccaaagatgcttacatgagctctgaggaccaggcctctggcggcattgtcctgcagctgaagctcggggatgaggtgtggctgcaggtgacaggaggagagaggttcaatggcttgtttgctgatgaggacgatgacacaactttcacagggttccttctgttcagcagcccgtgacagaggagagtttaaaaatccgccacaccatccatcagaatcagcttgggatgaacttattcagatggttttactttattaattcctccaattattacaataatcataaaaaggtgaaaatggaaaagttattcccaaaactgattctgtgtaacttactatttttccaggagtaaatatttaaaatagctgcatggtttattctaatttatttcacatttcttattcctattatctgaagaatccctcgtctgtgcgtttcttgtgggaagagtgttttaatatcattttagtgctctgaggagtcatatgaagatgtatccctcatctgtgtttctgaggacattaaggggaaattagagggaaatgtttattcaatttagtactagcaacagctttaagctggtgatgctgtcatactccagaaagctgtagacactgctcattttgtcttttaaaaaaattttattttattttaagttctgggatacatatgcaaaacatgcatgtttgttacataggtaaacatgtgctgtggtggtttgctgtatctatcaacccatcacctaggtattaagccctgcatgcattagctatttgtcctggtgctctccctcccactttgctcattttctaacctaggttttaatcaccattttacccaacaaatcattgttcgatcattatttgccagacttgaatctctatgtgttttctaggactgctctaataaagtacacaaactgggagtctttaaacaacagaaa

SEQ ID NO: 3968 - DNA, 1854 bp, Homo sapiens
tgatgtccctagacttctcagtggcaacaactcatccattcaggagctccatgtaaccactggttcagagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggacgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaagggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaaaggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatatgcccattaaatttgataagatcctgtataacgaattcaaccattatgatacagcagcggggaaattcacgtgccacattgctggggtctattacttcacctaccacatcactgttttctccagaaatgttcaggtgtctttggtcaaaaatggagtaaaaatactgcacaccaaagatgcttacatgagctctgaggaccaggcctctggcggcattgtcctgcagctgaagctcggggatgaggtgtggctgcaggtgacaggaggagagaggttcaatggcttgtttgctgatgaggacgatgacacaactttcacagggttccttctgttcagcagcccgtgacagaggagagtttaaaaatccgccacaccatccatcagaatcagcttgggatgaacttattcagatggttttactttattaattcctccaattattacaataatcataaaaaggtgaaaatggaaaagttattcccaaaactgattctgtgtaacttactatttttccaggagtaaatatttaaaatagctgcatggtttattctaatttatttcacatttcttattcctattatctgaagaatccctcgtctgtgcgtttcttgtgggaagagtgttttaatatcattttagtgctctgaggagtcatatgaagatgtatccctcatctgtgtttctgaggacattaaggggaaattagagggaaatgtttattcaatttagtactagcaacagctttaagctggtgatgctgtcatactccagaaagctgtagacactgctcattttgtcttttaaaaaaattttattttattttaagttctgggatacatatgcaaaacatgcatgtttgttacataggtaaacatgtgctgtggtggtttgctgtatctatcaacccatcacctaggtattaagccctgcatgcattagctatttgtcctggtgctctccctcccactttgctcattttctaacctaggttttaatcaccattttacccaacaaatcattgttcgatcattatttgccagacttgaatctctatgtgttttctaggactgctctaataaagtacacaaactgggagtctttaaacaacagaaa

SEQ ID NO: 3969 - DNA, 369 bp, Homo sapiens
gccccagcaacaaaggtttctcctctgggtttctgtttccctctttcagttcagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggatgtcctggcagcccggggaaggatgggacgagtggagagaagggagaacgaggagcagatggaaaagttgaagcaaaaggcatcaaaggaatgttcaggtgtctttggtcaaaaacggagtaa

SEQ ID NO: 3970 - DNA, 1111 bp, Homo sapiens
gccccagcaacaaaggtttctcctctgggtttctgtttccctctttcagttcagtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggatgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaaaggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaagggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatgtgcccattaaatttgataagatcctgtataatgaattcaaccattatgatacagcagtggggaaattcacgtgccacattgctggggtctattacttcacctaccacatcactgttttctccaggaatgttcaggtgtctttggtcaaaaacggagtaaaaatactgcacaccagagatgcttacgtgagctctgaggaccaggcctctggcagcattgtcctgcagctgaagctcggggatgagatgtggctgcaggtgacaggaggagagaggttcaatggcttgtttgctgatgaggacgatgacacaactttcacagggttccttctgttcagcagccagtgacagaggagagtttataaatctgccagaccatccatcagaa

SEQ ID NO: 3971 - DNA, 1063 bp, Homo sapiens
gcgcagtatctgggtccagcctgcagccctcgggtccagttcagtgtctgtcatctgaaccatgaggatctggtggcttctgcttgccattgaaatctgcacagggaacataaactcacaggacacctgcaggcaagggcaccctggaatccctgggaaccccggtcacaatggtctgcctggaagagatggacgagacggagcgaagggtgacaaaggcgatgcaggagaaccaggatgtcctggcagcccggggaaggatgggacgagtggagagaagggagaacgaggagcagatggaaaagttgaagcaaaaggcatcaaaggtgatcaaggctcaagaggatccccaggaaaacatggccccaaggggcttgcagggcccatgggagagaaaggcctccgaggagagactgggcctcaggggcagaaggggaataagggtgacgtgggtcccactggtcctgaggggccaaggggcaacattgggcctttgggcccaactggtttaccgggccccatgggccctattggaaagcctggtcccaagggagaagctggacccacggggccccagggtgagccaggagtccggggaataagaggctggaaaggagatcgaggagagaaagggaaaatcggtgagactctagtcttgccaaaaagtgctttcactgtggggctcacggtgctgagcaagtttccttcttcagatgtgcccattaaatttgataagatcctgtataatgaattcaaccattatgatacagcagtggggaaattcacgtgccacattgctggggtctattacttcacctaccacatcactgttttctccaggaatgttcaggtgtctttggtcaaaaacggagtaaaaatactgcacaccagagatgcttacgtgagctctgaggaccaggcctctggcagcattgtcctgcagctgaagctcggggatgagatgtggctgcaggtgacaggaggagagaggttcaatggcttgtttgctgatgaggacgatgacacaactttcacagggttccttctgttcagcagccagtga

SEQ ID NO: 3972 - DNA, 147 bp, Homo sapiens
gtgggtcccactggtcctgaggggccaaggggcaacattgggcctttgggcccaactggtttaccgggccccatgggccctattggaaagcctggtcccaagggagaagctggacccacggggccccaggttttccctttttgtatc

SEQ ID NO: 3973 - DNA, 1432 bp, Homo sapiens
actggtgctgaaccccgccgcgcgcgctttgaatttcccagccgctaagcgcctctcctggtcggtgtcccaggcagaaaggtgcagagacccatctgacgcaggactccaggtagacaagctccagcagagagtggccagatgtggtgcctggagcgactccgcttgggtcctgagtgccttcggcggagcggagactggcttctcccgggtcgggcccgcggagccaagtctcgcaccaccgccgcgtgcgcaaatgtgctcactccggaccgcatccctgagttctgcatcccgccacggctcatgccccgcctggccttggctgcgctccggaattcttgggtcgaagaagcagggatggacgagggcgccggccgcacagactgggacccgcgctcgcaggccgcgctgtcactgccgcacctgccccgtgtgcgcaccgcctacggcttctgcgcgctgctcgagagcccgcacacgcgccgcaaggagtcgctcctgctcgggggcccgcccgcgccccggccccgggcccacacctacggcggcggcggcggcccggacgccctcctggggaccctgcgcgtcccgcgagctccgggcccggcgacccccgcggcccccggctgtccccgcccgccccaggacgcgctcgcccggcggccccgcggctgccgcctcctgcgcgtccccgacgggctgctgagtcgcgcgctgcgggctgggaggagtcgccgcctgacccgcgtccgctccgtctccagcgggaacgaggacaaggagcgccgcgcgggctcccagtccccggcccgggccccctccacgagcccgccgtcgtcccgggtcccgtttcccgagcgcctggaggccgagggcaccgtggctctgggccgcgccggcgacgccctgcgcctggccgccgagtactgtccgggaaccgggcggctccgcctccggctgctccgcgccgagagcccggccggaggcgcccccgggccccgagccgtcagctgtcgcctcagcctcgtcctgcggccgccgggcaccgcgcttcggcaatgcagcactgtggtggggcgcagccgcaaggcctcctttgaccaggacttctgcttcgacggcctctcggaggacgaagtgcgccgcctggccgttcgagtcaaggcccgggacgagggccgcggccgggagcggggccgcctgctgggccagggtgagctgtccctgggcgccctcctgctgctctgagggcccagccctccccggggcgctctgcccgggggactccggacactgacagccgcgtggtacaaaataaacgtgtatttgttgttcttatcagtcccgtttcagtacaacactggcagagatgattctagattaactatcccagtaaaagatatgatattttccatagatacctccagaa

SEQ ID NO: 3974 - DNA, 1579 bp, Homo sapiens
agtactgaaggtggcgcctcggcagcgggctagaggccactggcactgagcttgcaaccagatccagagacactgaagaagagagaaaggcgcacctcttcccgccactcctagccccagcctccaaggatgcggctcctcgagaaactctgttcctcggccgcaggcagctccgcgccgaagcccgccttcgccaaagtgctcacgccgaatcgcatccccgaattctgcatcccgccgcggctgccggccccttgcacgctcgagtctccaatccgggccgccgccgtgccccggcgctgcgccgctgaaagcgacctgtggccccgcgcggcagacgaggacgccggccgcacggactgggacccgcgctcgcaggcagcgctgtcactgccgcacctgccccgtgtgcgcaccacctacggcttctgcgcgctgctcgagagcccgcacacgcgccgcaaggagtcgctcctgctcgggggcccgcccgcgccccggccccgggcccacagctgcggcggcggcggaggcccggacgcccccctggggaccctgtgcggcccgcgaggtccgggcccggccacccccgcggcccccggcggtccccgcctgccccaggacgcgctcgctgcggggccccgccgctgccgcctcctgcgcgtccccgacgggctgctgagtcgcgcgctgcgggctggaaggagtcgccgcctggcccgcgtccgctccgtctccagcgggaacgaggacgaggagcgccgcgcgggatccgagtccccggcccgggccccctcctcgagcccgctgtcatccagggccccgcttcctgagcgcctggaggccaagggcaccgtggctctgggccgcgccggcgacgccctgcgcctggctgctgagtactgtccgggaacccggcgtctccgcctccggctgctccgcgcggagagcctgttcggaggcgcccccgggccccgcgccgtccgctgccgcctcagcctcgtcctgcggccgccgggcactgcgcgttggcaatgcagcgctgtggtggggcgcagccgcaaggcctcctttgaccaggacttttgcttcgacggcctctcggaagacgaggtgcgccgcctggccgttcgcgtcaaggcccgggatgagggtcgcggccgggatcggggccgcctgctgggccagggtgagctgtccctgggcgccctcctgctgctctgagggcccagccctccccggggcgctctgccctggagactccggacactgacagccgcgtggtacagaataaacgttatttatttttttatttatgatactgctttattgacgttttacttcctcaccatccacatttgtcatcgtctattggtaaagaagaaaaagataatgactccctgttctgttcacaggacccccatatctctttccagaccatttttgcattccaaggaaaaatgggttggcttgggactgggagagaaaggaagtacacccatctgcattgtttttaattccttccggttttctatcaatgttacagtttttttttaataaagcaagttattcattcaga

SEQ ID NO: 3975 - DNA, 3124 bp, Homo sapiens
gcggtttcccgccgcgggtgaatgagtccgactgcgctgccgccgccgccgccgcccgcatcgaagctccggccgcgtcccccgcgccagccccgggagcctgcgcgccgagacccctgcgtgtctgcgaacagacctccggcctcgggccatcaccccgggcagacgctgcagcccctgtccgggcctcttgcctgccgcccccatgagaaaaaccaacatgtggttcttggagcggcttcgggggtctggggaaaacggtgctgcccggggcgtggggagtgaggcgggggacaaggcctccaaggggcccctgtacagcaatgtgttgacgcccgacaagatccccgactttttcatcccccccaagctgccctcgggccccgcggagggcgagggacaggccgcgctgggcccctccacgtcggaacagaacctggcctctgcggccccccgccagaccccacggagcccccggctgcctgccaagctggcagccgagagcaagagcctgctgaaggcagccacccggcacgtgatccagatcgagagtgccgaggactggctgtccgaggaggccactgacgccgacccccaggcccagggtgccatgtccctgccctcggtgcccaaggcccagacgtcctacggcttcgccatgctggctgagagcccccacacgaggcgcaaggagtctctgttccacagtgagcacggggctctggcccaggtgggctccccaggggccgggcgccgccgggcagctgccaaggccaacgggggtgatgggggccccagggaggctggcggggccctcatgagccccggccgctacttcagtggcggggagagcgacacagggtcctcggccgagtcctcccccttcgggtcccctctgctgtcccgctccgtgtctctgctcaaaggtttcgcccaggacagccaggccaaggtgagccagctccggcactccgtgggccgccacggctccctgtctgcggacgacagcaccccggacgccagccccgggagccggcgccgcctgacccgccgggcacccccggaacctggccccgagtcgggccaggcgcgtggggagcacacggtccacgtgggccctcggggcagcgtgcggctgctggccgagtacgaggccggccaggcccgcctgcgggtgcacctgctggccgccgagggcctctacgaccgcctgtgcgacgcccgcagcatcaactgctgcgtgggcctgtgcctggtgccgggcaagctgcagaagcagcgcagcaccatcgtgaagaacagccgccgccccgtcttcaacgaggatttcttcttcgacggcctggggcccgccagcgtccggaaactggccctcaggatcaaggtggtgaacaagggcagcagcctcaagcgggacacgctgctcggggagaaggagctgcccctgacctccctgctccccttcctgtagagcggggacctgctcgctgtccgctcgggtgcagagggcagaccccggtctctcctccacaccgggtgctggcgggcgggtccgctggcttgggctggggctggccggggaggggctcacactcaggctgggctgggcgctgatgctgtagctgacgcagggtttcctgggtcacccgatgctgactggagtattatttttcatgaattaatttctcctttggaggaggaggaggaggaggagaggggcctcgggggaagagaaggggccacttcgcggggcagagggtccccctttgcccctccacactgcctcgcgcctttcacgcagagttctagaaggaggttctcaggggttcaggaatccgtgcatgtggccagggcggggccgtggacagggaggtgacaagtcttggagcccacagtctccttcactgcacgtgtgtcttcctcccccacagcctgccgccatccagttcccaccccgcggagagcagggcctcgcggccacaccaggcccaggctctgcccgggacgccccctcccaggggtcaggcttggctctgggagaccccagcttcccaggctccggtggggagtggggccaggcgagggtgccctgacgagggtgggcgcggagggagcagccgctgccacagtcggagcagaggaggtcttggcagaggtccgcggggaggagacggctctcctggcctgttttcctccaacactgtcgccgctggctttttgggtacaggcccgtctggccatttctgctgtggcgccggagggtcttgctcagagatgcccagagagcagccctatggcccatccgtcctcgctgggggctgccaccccgtcgcccttttgtccagcgtctgcagctgggagcgacacgcagtgattgacggccgtggctttgacgccacgtgtgtaaataggctgtggctacggtgggtgggtcggagcccaggaggcagctggggggacctggctatggcctttcctgctgttaggtggctgcaaggcttccattgtgtggttatgtgggtccttgaatgattttggggaggtttccagctcagaatgatgcagaaatgataagactcaaagcaggggccaggccaggccagtgccttcgcctctcccggctgctggtgggcacggaggaaccagggcacatctgtggtacccagggacgtcccttgtcagcccgtttgccacacattgttcctcttgtccaggggagggtggaggagctgcttcccaggactggaggagcagctgggcccctgctgcacgtccggtgggacacacctgtgagccctccagagggagagtgcaggccccttctgagcctggtgttgcagggctccgctctctcccggaagccagggcacccagggcggaggctcctcaggccggggaggcggggagggtgccctgcatggagagagacgccggcgctccccgccttctctgatgctcacccctcccaggccctgttctccctggggtcccccgtttagtagcccccctgcactctttgatatcttagtgtctgaggttgactgtgggtaaatctttaagacactccccagctgtgtttgtttataaatgctgtttatagtgcaataaaggtgtttcgggaata

SEQ ID NO: 3976 - DNA, 4591 bp, Homo sapiens
ctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagggaaaaagagagaaatgtatgagcatcctgtcttctgcttggcctcccaagtgatggatttaaccattcaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaaca

SEQ ID NO: 3977 - DNA, 5190 bp, Homo sapiens
tcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagaaaatgtaggccggttaatcactcctgccaaaaagcttgaagatacaatacgtcttgctgaactagtcattgaagttcttcagcaaaatgaggagcaccacgcagaggcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaa

SEQ ID NO: 3978 - DNA, 5500 bp, Homo sapiens
ggctgcatcgacagcttgcaacactcggcatcttttctggaggcgcctccttcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagcaaactcttgtactacagaaaatgtaggccggttaatcactcctgccaaaaagcttgaagatacaatacgtcttgctgaactagtcattgaagttcttcagcaaaatgaggagcaccacgcagagccacatgttgataaaggagaagcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaagagtttaaccagtaacctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagaaatacaaaaaaatgagacatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaatata

SEQ ID NO: 3979 - DNA, 5471 bp, Homo sapiens
acagcttgcaacactcggcatcttttctggaggcgcctccttcagcagccgcagatggcatccggctgcgggctcggggctcgcaattgattctcccccttgcccacctcgagtccacggacgcacctctcccttcccctcctcccttcgcgcttctgggtctgagcccagctcgcgaccgccgggcagaggatcagtcgcggcggccgaggctgagcagcagcgctctcgctccctgacctggggagaagcgcccacccgggagagctgatccccggctgcctccagcgccccccaccttttgcactccaagccgggggctccagagaccccgctccccaggcgccactatgctggacccttcgtccagcgaagaagaatcggatgagatcgtggaggaggagagcggcaaggaggtgctcggctcggccccgtccggcgcgcgcctgtctcccagccgtaccagcgagggctcggccggcagcgccgggctggggggcggcggcgccggcgccggagccggggtgggtgcaggcggcggcgggggcagcggcgcgagcagcggcggcggggccggggggctgcaacccagcagccgcgctggcggcggccggccctccagccccagcccgtcggtggtgagcgagaaggagaaggaagagttggagcggctgcagaaagaggaggaggagaggaagaagaggctgcagctgtatgtgttcgtgatgcgctgcatcgcctacccctttaatgccaagcagcccaccgacatggctcgccggcagcagaagatcagcaaacagcagctgcagacagtcaaggaccggtttcaggctttcctcaatggggaaacccagatcatggctgacgaagccttcatgaacgctgtgcagagttactatgaggtgttcctgaagagcgaccgtgtggcccgcatggttcagagtggaggctgttccgccaacgactcccgggaggtcttcaagaagcacattgagaagagagtgcgcagcctgcctgagattgacggcctcagcaaggagactgtgctgagctcctggatggccaaatttgatgccatctaccgtggagaagaggacccgcggaagcagcaggcccggatgacagccagcgcagcctccgagctgattctgagcaaggagcaactctatgagatgttccagaacattcttgggatcaagaagttcgaacatcagctcctttacaatgcctgccagctggacaatccagatgagcaagcagcccagatcagacgagagctggatggacgtctacaaatggcagaccaaatagccagggaacgcaaatttcccaagtttgtatccaaagaaatggaaaacatgtacattgaggagctgaagtcatctgtcaacctgctcatggccaacttggagagcatgccggtatccaaaggcggggagttcaagctccagaaactcaaacgcagccacaatgcttccatcatcgacatgggcgaggagagtgagaaccagctctccaagtcagatgtcgtgctgtctttctcattggaggtggtaattatggaagtccaaggcctcaaatctttggctccaaatcgcatcgtatattgcacaatggaggtggaaggaggagagaaactacagactgatcaggccgaggcttctaaaccaacctggggcacccagggtgacttctccacaacccatgcactgccagctgtgaaggtgaagctgttcacagagagcacaggcgtcctggcgttggaggacaaggagcttgggcgggttattctccatcccaccccgaacagccccaaacagtcagagtggcacaaaatgacagtctccaaaaactgccccgaccaagatctcaaaatcaaacttgctgtccgaatggataagcctcaaaacatgaagcattctgggtatttatgggccatcggtaagaatgtctggaagagatggaagaaaaggttttttgtattggtgcaggtcagtcagtacacgtttgccatgtgcagttatcgggagaagaaagcggagcctcaggaacttctacaattggatggctacactgtggattacaccgacccccagccaggtttggagggtggccgagccttcttcaatgctgtcaaggagggagacaccgtgatatttgccagtgacgatgaacaagaccgcatcctgtgggtccaggccatgtatcgggccacggggcagtcacacaagcctgtgcccccgacccaagtccagaaactcaacgccaagggaggaaatgtacctcagctggatgcccctatctctcaattttacgcagatagagctcaaaaacatggcatggatgaatttatctcttccaacccctgtaactttgaccacgcttccctctttgagatggtacaacgccttactttggatcacagacttaatgattcctattcttgcctgggctggttcagtcctggccaggtgtttgtactagacgagtattgcgcccgaaatggagtccgggggtgtcaccgacatctctgctacctcagagacttgcttgaacgggcagaaaatggcgccatgatcgaccccacccttcttcactacagctttgccttctgtgcatcccatgtccatgggaacaggcctgatggaattggaactgtgactgttgaagaaaaggaacgttttgaagaaatcaaagagaggctccgagttctgctagaaaatcagattacacattttaggtattgctttccatttggtcgacctgaaggtgctttgaaagctactctctcactcttggaaagggttttgatgaaagatattgttaccccagtgccacaagaggaggtaaaaacagttatccgtaaatgtctggaacaggctgcgttagtcaactattctcggctctcagagtatgccaaaatcgaagagaatcaaaaggatgcagaaaatgtaggccggttaatcactcctgccaaaaagcttgaagatacaatacgtcttgctgaactagtcattgaagttcttcagcaaaatgaggagcaccacgcagagccacatgttgataaaggagaagcctttgcgtggtggtcagatttaatggtggagcatgcggagacgttcctgtcactctttgcagtagacatggatgcagccttagaggtgcaacctccagacacatgggacagttttccactatttcagctgctgaatgattttctccgtactgactataatttgtgcaatggaaaatttcacaaacacctgcaagacctgtttgccccacttgttgttagatatgtggatctgatggagtcctcaattgcacaatccattcacaggggctttgagcgggagtcatgggaaccagtcaagagtttaaccagtaacctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaatat

SEQ ID NO: 3980 - DNA, 2095 bp, Homo sapiens
acctacccaatgtgaacctacccaatgtgaaccttcccaaagtaccaaatctaccagttaacatccctctaggcatcccacaaatgcctactttttcggcaccgtcatggatggctgctatatatgatgcggataatgggtcaggcacctcagaagatctgttttggaaacttgacgcccttcagaccttcattcgggacctgcactggcctgaagaagagtttggaaagcacctggaacaacggctgaagttgatggcaagtgacatgatcgaatcttgtgtcaaaagaaccaggattgcatttgaagttaagctgcaaaaaaccagtcgatcaacagattttcgagtcccacagtcaatatgcaccatgtttaatgttatggttgatgccaaagctcaatcaacaaaactttgcagcatggaaatgggccaagagtttgctaaaatgtggcatcaataccattcaaaaatagacgaactaattgaagaaactgttaaagaaatgataacactcttggttgcaaagttcgttactatcttggaaggagtgctggcaaaattatccagatatgacgaagggactttgttttcttcttttctgtcatttaccgtgaaggcagcttccaaatatgtggatgtacctaaacccgggatggacgtggccgacgcctacgtgactttcgtccgccattctcaggatgtcctgcgtgataaggtcaatgaggagatgtacatagaaaggttatttgatcaatggtacaacagctccatgaacgtgatctgcacctggttgacggaccggatggacttacagcttcatatttatcagttgaaaacactaattaggatggtaaagaaaacctacagagatttccgattgcaaggggtcctggactccaccttaaacagcaagacctatgaaacgatccggaaccgtctcactgtggaggaagccacagcatcagtgagtgaaggtgggggactgcagggcatcagcatgaaggacagcgatgaggaagacgaagaagacgattagaccatttggtcctagagtctgctgggacagagtcctgtaatcagtgcatgtccttagtctgttagttaaacccattaggaattttctgtcaactaccatgcccatgagatgtttatcaatacaactgccattttagctatgtggtaccaagattagcaaatgaccttcatatccactgatttcctgatgtccatgtctatatgtttacaagcaatatggagcaccattctttaaatactgttcatggagaatacatagtctaaccactaggcgtgtccctgttatcagcaaagatcaatgatgcttcattcatgtactatgtatgcattggtggtaaatggatgtgagggcaagtacatcaagtacattcactctgtttcacgtatgtggatgccagttaattaaatgagtacgtaaataaattaattaaaacacatagatctgctttgtgtttttatttttattttttgaaaaacaaaaggcaagtctccaacaattaacttttgatgctttctgttcccctaaaaccaaaaaatgaaccccttgtgtcgttgttaacccatcctttcatttactcatataattagccaaaaaaaaaaggatggctacataccaatggattgattctcttaattgccacggcaagggggcgatcctatcatgacttaacatcaagcgcgcagttcaaaactactgtcttctgtcaaagttttctcctcttaaatgttattttgcttttacgtctcaactgtgtatgtaaaaaaaatgaatatttaaattacaaccctagactaaaaatgtgtttataataagatgtggatatttccttcagtagattgtaaccataatttaaattattttgttccacactgttttttatatctgtcatgtacattgcattttgatctgtaactgcacaaccctggggtttgctgcagagctatttctttccatgtaaagtagtggatccatcttgcttttgccttatataaagcctacagttatggaagtgtggaaaactgtggcttctcaataaatattcagatgtcctaagaata

SEQ ID NO: 3981 - DNA, 5928 bp, Homo sapiens
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagaggtatgtagaatttttcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgat

SEQ ID NO: 3982 - DNA, 6045 bp, Homo sapiens
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctgaatttacagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgat

SEQ ID NO: 3983 - DNA, 6042 bp, Homo sapiens
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagagctaagacatgcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgat

SEQ ID NO: 3984 - DNA, 2826 bp, Homo sapiens
tgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaa

SEQ ID NO: 3985 - DNA, 4308 bp, Homo sapiens
ttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagtttggtagtcaatggcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaa

SEQ ID NO: 3986 - DNA, 6066 bp, Homo sapiens
attcaattccacgtgttgcttgttgtaggcgccacaggttccccacctgcgtccgggcgctcgggcggctccgcctctgccggcgggctctggggaaccgctgggtcggcgcgcccggggctggcggagcaattcctgaggcgcccaagctcacccccaacgctaactccgcctattcagtcccggcggctccccctctcccccctcccaatcctcctcccggctcctgcccgcccctttcgccctggtggtaggaaacactcctgaatctaactcgacgtgtccggaaagccctggccagttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctgaatttacagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatcccaactatctgactctgtgtttttgtttcttgagttttttgtttgttttgtttgtaatattttgtttttaatcaaatgagtaaaagatagtaacactgactgttctttgtacctaataggcacatacattgttaaaagaattactatgacagcatatttccatagcagaggaaatatatatttcatatattattagttaatattagtaatcaatgttaactaataattagtaatgttagtaatattaactagtaattcacattattagtggttctctcaaaatattttcttgctagggtttgagagataattgtattatgttgcgtaagttctctatgaattatttttgtgatatttcccaaaacatattggcagattgtgctactgcatttattaataagtaatttttaaatgaaggcagttaatgcagaataagtggaggtatccctgcatttatgaaaacgtttattctgaaactttagaaatgaaacaacttggacctccagattcgttctcccatggtgtaataagtggtcgttaggtacctagactagccttaaaaatctatttaatctacagttactatttagcattgttttggctcattttctgggccctagggctaagataacaaacaaggaaatttcttccttcttccgggattaaagactaactctaccaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttgat

SEQ ID NO: 3987 - DNA, 4073 bp, Homo sapiens
ggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcggcgggacgcgccggggcgcgcgggcggcggcggcgcggccagatctgtgagcccgagcccctctgtgctcagcgaggggcgagacgagccccagcggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttctggtaaagatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagagggaagagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgcc

SEQ ID NO: 3988 - DNA, 2238 bp, Homo sapiens
attacactagactcacagaatatgccaaaatagaaggcccagcagaaaaggaaacagagaccatgaaccaggcatctcctgctagaaagctggaagagattcttcatctggcagagctctgcatagaagtcttacagcagaatgaagagcatcatgcagagggaagagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaagaatatcgccaacagtcttcccaatgtagctcttccaaaagttccaagtctgcctcttaatcttccacagattcctaacatttctactgcttcgtggatgccttctttatatgagtccaccaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcat

SEQ ID NO: 3989 - DNA, 4631 bp, Homo sapiens
agttttcctttcgttctgcggccgctgcagccagccccgcggctccctcagacccgcgggcgcagccgccgggggtgaggcgcttggggaccgcgggccgagcggcggggatccccgagcaccatgctggacccgtcttccagcgaagaggagtcggacgaggggctggaagaggaaagccgcgatgtgctggtggcagccggcagctcgcagcgagctcctccagccccgactcgggaagggcagctggacgatgagcaggagcggaggatccgcctgcagctctacgtcttcgtcgtgaggtgcatcgcgtaccccttcaacgccaagcagcccaccgacatggcccggaggcagcagaagcttaacaaacaacagttgcagttactgaaagaacggttccaggccttcctcaatggggaaacccaaattgtagctgacgaagcattttgcaacgcagttcggagttattatgaggtttttctaaagagtgaccgagtggccagaatggtacagagtggagggtgttctgctaatgacttcagagaagtatttaagaaaaacatagaaaaacgtgtgcggagtttgccagaaatagatggcttgagcaaagagacagtgttgagctcatggatagccaaatatgatgccatttacagaggtgaagaggacttgtgcaaacagccaaatagaatggccctaagtgcagtgtctgaacttattctgagcaaggaacaactctatgaaatgtttcagcagattctgggtattaaaaaactggaacaccagctcctttataatgcatgtcagctggataacgcagatgaacaagcagcccagatcagaagggaacttgatggccggctgcaattggcagataaaatggcaaaggaaagaaaattccccaaatttatagcaaaagatatggagaatatgtatatagaagagttgcggtcttcagtgaatttgctaatggccaatttggaaagtcttccagtttcgaaaggtggtccggaatttaaattacaaaaattaaaacgttcacagaactctgcatttttggacataggagatgagaatgagattcagctgtcaaagtccgacgtggtactgtcattcaccttagagattgtcataatggaagtgcaaggcctgaagtcagttgctcccaatcgaattgtttactgtacaatggaagtggaaggagaaaaacttcagacagaccaggccgaagcctcaaggccacaatgggggactcaaggagatttcaccaccacccatcctcggcctgtggtcaaagtgaaactcttcacagaaagcactggagttctggccctggaagataaagaactgggaagggtgatattatacccaacttctaatagctccaaatcagctgaattacaccgaatggtagttccaaaaaatagccaggattctgacttaaaaatcaaactggcagtgcgaatggataaaccagcacatatgaagcatagtggatatctgtatgcccttggacagaaggtttggaaaagatggaaaaaacgttactttgttctagttcaggttagccaatatacctttgctatgtgcagttatagagaaaagaagtctgaaccacaagaattaatgcagcttgaaggctatactgtggattataccgatccccacccaggccttcagggtggttgtatgttctttaatgctgttaaagaaggagatactgtaatctttgccagtgatgatgaacaggacagaatattatgggttcaagccatgtatagggccacaggtcaatcatataaaccagttcctgcaattcaaacccagaaactgaatcctaaaggaggaactctccatgcagatgctcagctttatgcagatcgttttcagaaacatggtatggatgagtttatttctgcaaacccctgcaagcttgatcatgccttcctttttagaatactccagaggcagactttggatcacagactgaatgattcctattcttgcttgggatggtttagccctggccaagtctttgtgttagatgagtactgtgcccgttatggtgtgagaggctgtcacagacatctctgctaccttgcagaactgatggaacattcagaaaatggtgctgtcattgaccctaccctgctccattacagctttgcattctgtgcctctcatgtgcacggcaacaggcctgatggaattgggactgtttcagtggaagaaaaagaaagatttgaggagataaaagagagactctcttcccttttagaaaatcagataagccatttcagatactgttttccctttggacgacctgaaggtgctctaaaagctacactttcattacttgaaagggttttaatgaaagatattgccactcccataccagcagaagaggtgaagaaagtggtcagaaaatgtctcgagaaagctgccttgatcaattacactagactcacagaatatgccaaaatagaagagaccatgaaccaggcatctcctgctagaaagctggaagagattcttcatctggcagagctctgcatagaagtcttacagcagaatgaagagcatcatgcagaggcatttgcctggtggcctgatttattggctgaacatgcagagaaattttgggctttatttacagtggatatggacactgcactagaggctcaaccgcaagactcctgggatagttttcctcttttccaactgcttaataatttcctccgaaatgacacacttttgtgtaatggaaaatttcacaaacacttgcaagaaatctttgtacccttggttgtccgctatgtggatctcatggagtcttccatcgcccagtcaattcacagaggttttgagcaggagacatggcagcctgtcaacaatggctcagcaacatcagaagaccttttttggaagcttgatgcactgcaaatgtttgtctttgatctgcactggccagaacaggaatttgcccaccacttagagcaaagacttaaactaatggccagtgatatgctagaggcctgtgtcaaaagaacaagaactgcatttgaactcaagctacaaaaggcaagcaaaacaactgacttgcgcattccagcttccgtttgcactatgtttaatgtattagtcgatgccaaaaagcaaagcaccaaactctgtgccctggatggaggacaagagtttggtagtcaatggcaacagtaccattcaaaaatagatgatctgatcgacaacagtgtaaaagaaatcatttcactgttagtttcaaagtttgtttcagtgttggaaggcgtgttgtctaagctgtcaaggtatgatgaaggcactttcttttcatccattctgtcattcactgtgaaagcagctgcaaaatatgttgatgttccaaaaccaggaatggatctggcagacacctatattatgtttgttcggcaaaaccaagatattcttcgagaaaaggtcaatgaggaaatgtatatagaaaagttatttgatcaatggtacagcagttccatgaaagtcatttgcgtgtggttgactgatagattagacctccaactccatatttaccagctgaagacgctcatcaagattgtgaagaaaacctacagggactttcgattgcagggtgtgttggaaggaacactgaacagtaagacttatgatactgtgcacagacgtttaacagtagaggaggccacagcctctgtttcagaaggaggaggacttcagggcattactatgaaagacagtgacgaagaagaagaaggctgatatcacacagctttgcagaaggaaggaagaccttgatcgacattgttttttatttttttaaccttgtccttgtaattacattcattgtttgttttggccaaataaaaatgcttgtatttctttaaaaagtaagcctgaatgtagagtaaaaggggaaatgccaagattttggggtttttttgtttcctttttttgtttgtttgtttgtttgtttttttggagaagagcatcctcttttgtgtagtttgacctaaaaatgaaccttggctctgcttgtgatcagaacatgaacttttttttttaaagaagatttgagcatttttctgtaatcacatcaaaatgatgttttctgtgtaaagcgagatacatatttctcataatgcagcattgtgagaagtcagttcggaccactgcaccaacactgtcgtatccttgttaaaatggtgtgtaccttacaaattataatttatgtgccaggttcgttttgtacttaatttgctattattgtgatgtgtataaaatctttaatcttggttcttagtactttgaattggtctacaggtatattcctgggatgaaaggattgccaaacccaaatatagactagattatccaatgggtttgtgtctttgttccattctcaacatttcttctttcaactataagtaatccccaggtgtggggtagcaagtgtgcttccgtcaagataccatattctcctgctccagtataacagcttgcaggcaataaaaatctatttgctcataactacttctgtatttattagacttatatagagcaaatgcagtaaaagaggtttgcagtgtttcaaacatccc

SEQ ID NO: 3990 - DNA, 3438 bp, Homo sapiens
acttgcaaatcgctgtgtgctcgcagaagccagcacttccacagtctctaaccttcccatggcgagtgctgcagctctatcagcagaacctttctctccgtgtgaggaagagcttttttcccccctttccttttttttttttttcctttccccttaatcagaagcactgaatgaaagccaatcagagagagctcgcccccgttttcttcggttccctgctgtccagagttaaaagtgatgctgagaaagagcttgagttagattgaagtagaatcagtgatagaaaataacagccgaaaacaaacaaaaaggggacatagtgacaatttctcctgggttattttggctggaaccaacttccattatccagaagctgataaaaaagctttgggaaacatgaacaaaacattgatgaaatgttggaaaccagttgaaacacagtaaaaccaactgggtaaaataggaccacttctcttcatctacactgggatttgtcaagaagtgaactatgacaatacatcaatttttgctactgtttctattctgggtatgcctgccacatttctgctctccagaaataatgttcagaaggacgcctgtgccacagcaaagaattttaagttcacgtgtaccaaggagtgatggcaaaattctccatcgtcaaaaacgtggttggatgtggaatcaatttttcttacttgaagaatatacaggatctgattatcagtacgtaggcaagctacattcagaccaagataaaggagatggatcactcaaatatatcttatctggagatggagctggtactctttttattattgatgaaaaaacaggtgatattcatgccacaaggcgaattgatagggaggaaaaggccttttatactctacgcgcacaagctattaacagaagaactctgaggccagtagagccagagtcagagtttgtgatcaaaattcatgatatcaatgacaatgagccaacgttcccagaagaaatctatacagctagtgttcccgaaatgtctgttgtaggtacttctgtggtgcaagtcacagctacagatgccgatgacccttcatatgggaacagcgccagagtcatttacagcatacttcaagggcagccctatttctctgtggagcctgaaacaggtatcatcaggactgctttaccgaacatgaacagagaaaacagagagcaataccaagtggtcatccaggccaaagacatgggcggccagatgggaggcttatcggggacaaccactgtgaacatcacgctgacagatgtcaatgacaacccaccacgtttcccccagaacactattcatcttcgagttcttgaatcctccccagttggcacagccattggaagtgtcaaagcaactgatgctgacactgggaaaaatgctgaagtagaataccgaattattgatggtgacggtactgatatgtttgacatcgtgactgagaaggacacacaggaaggcatcatcactgtgaaaaagccactcgactatgagagccgaagactttatactctgaaagtcgaagcagaaaacacccatgtagatccccgtttttattacctaggaccatttaaagatactaccatagtgaaaatctctatagaagatgtggatgaacctcctgtttttagtaggtcctcctatctgtttgaagttcatgaagatattgaagtgggcacaatcattggtactgtaatggcaagggacccagattctatttccagccccattagattttccttggatcgccatactgaccttgacagaatctttaacattcattcaggaaatggatctctttatacatcaaaacctcttgaccgtgaactatctcagtggcataatcttactgttattgctgctgaaatcaacaatcccaaagagacaacacgcgtggctgtttttgtgagaattttggatgttaatgacaatgccccacagtttgctgtgttctatgacacttttgtatgtgaaaatgccagaccagggcagctaatacagactataagtgcagtagacaaagatgaccctttaggtggacagaaattttttttcagtttagctgctgtcaatccaaacttcacagtacaggataatgaagataatactgccagaatcttaaccagaaaaaatggattcaatagacatgaaatcagtacctatctcttgcctgtggtgatatcagacaatgattacccaattcagagcagcacaggcacactgaccattcgagtgtgtgcttgtgacagccaaggcaacatgcaatcctgcagtgctgaagccctgctcctccctgccggcctcagcactggggccttgatcgccatcctcctctgcatcatcattctactggttatagtagtactgtttgcagctctgaaaagacagcgaaaaaaagagcctctgatcttgtcaaaagaagatatcagagacaacattgtgagctataacgatgagggtggtggagaggaggacacccaggcctttgatatcggcaccctgaggaatcctgcagccattgaggaaaaaaagctccggcgagatattattccagaaacgttatttattcctcggaggactcctacagctccagataacacggacgtccgggatttcattaatgaaaggctaaaagagcatgatcttgaccccaccgcacccccctacgactcacttgcaacctatgcctatgaaggaaatgattccattgctgaatctctgagttcattagaatcaggtactactgaaggagaccaaaactacgattacctccgagaatggggccctcggtttaataagctagcagaaatgtatggtggtggggaaagtgacaaagactcttaacgtaggatatatgttctgttcaaacaagagaaagtaactctacccatgctgtctccacttcacaatatttgatattcaggagcattttcctgccagtcagcacaattttttttctcatttacttcttaatttgttcattaattacattaattctttcctgtaggatgtctcatggaatatatatgacattttatttaatcacttccaagagccaaagctatggaaatacagtgttgtccatcttagtaaataaaagataatttcagaaacatgaacaggatagttctcccttaagcaacctcacaaacaagccgcttctgttaggtacatgtcctgcccttgcaaatgaagcttttaaaaaggtgaagaaaaattttacagtatatcctgttctgtacattaaattaaaaaaacaaaaatgtacatgtgatgttagtaggtgtgatatgcaacctggtatacagacatttgtgcaatttcatttcatcaaattctatctgctaatgttttatatttatatttttgtatttatttttaaaaaaataaaccagtttttacaacta

SEQ ID NO: 3991 - DNA, 4164 bp, Homo sapiens
cgcctaatcttcacccgctgctaggctcgtttaatgagtcttctgagagctaaggagtcctcggattcattcaaagcattctacaatgaacgctaggggggaaaaagaacaaacaaaatacatttcaaatataggattcaattacttttcactactcaatgatgtgtcaaaggcacgctgtgttttgttttgagggcggggagatgacaggagggaatcctgggcccccattggctcgccgctcgccgctgcagttgagctccagccgctccgagagcattattgatctgaagggtaaatgtggagggagccacagagaggggtccaggcttttctgagaagagaggcagcctcttccaggaagaaagtggtgtctactggctgcccggcctggagaaccttctttgaatgaaaacggacaaaatgcaaagcagtgtgttggcacagtgatttggaaaggggaaacagaagagaagggtctcaccttccgcgcaaggctgagctgttggcaccctgctgcggccgtcggtgctgctgctcctgcagctgccttttctgccatcagctttgttacctaacagcttggctcttttgggaaatatagacaagctggaacccaggagcagttgggagttttaaagaatgccagcctttttaaagctttgatgtccagtgctatagaatcaagttactgtggaggtcaaaacaatttgagatacataagctggccttagaaaataaattgcctctaacttacagtgaggagctcaacataacagggaaaaggagcacaggatgcagctacttggagggtgttgattgaaaacttcgatctccccaccccattcacggttgatttgacggatttctcacctcgttcacagagaaaatttcaattaaggcccctttagatggaatataatacagcagaagccttttcatcaaaaggattaatgcctgcatcatcatttctgcaataaaacaagaagctaagtggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaaaaagaaacacaaatattaatagaaatctctctcacacacacacacacacacaaacacacacacacacacacacactctgggacaagattcctttgattacctggtttctagtaagttactaaattaatcatattgtcagttttggtttattctgccaacaagagatacatcctataatgtgtacttgctttgttttgttgttttgttttttcacaatcacactgagacaagctcaggcctattcaatacaatttactgacatgacaacctagaacgaagatagctatgtggcatcacggtggaagagtgttagatttttcttaattccactaaagtgcctattgaaactcttatcatttaaagtggtgtacagtacactctgctgtgatggtattgcgggattcagagataaagacataaaacaaagacaccgtctttatgtcaagaagcaatagcgacactctgactctcctcattccttttgagaacaaaagaagaacactttctgatctccaccttcttctaattcaaaaggttttctttttcttttttaaactgtatgctaaaacgtatttgtttatcctatcctttcagaaaattgaaataaatatgaaaatatcaagttcaatatgtaagtccc

SEQ ID NO: 3992 - DNA, 4163 bp, Homo sapiens
attgatctgaagggtaaatgtggagggagccacagagaggggtccaggcttttctgagaagagaggcagcctcttccaggaagaaagtggtgtctactggctgcccggcctggagaaccttctttgaatgaaaacggacaaaatgcaaagcagtgtgttggcacagtgatttggaaaggggaaacagaagagaagggtctcaccttccgcgcaaggctgagctgttggcaccctgctgcggccgtcggtgctgctgctcctgcagctgccttttctgccatcagctttgttacctaacagcttggctcttttgggaaatatagacaagctggaacccaggagcagttgggagttttaaagaatgccagcctttttaaagacagtgaggagctcaacataacagggaaaaggagcacaggatgcagctacttggagggtgttgattgaaaacttcgatctccccaccccattcacggttgatttgacggatttctcacctcgttcacagagaaaatttcaattagcccctttagatggaatataatacagcagaagccttttcatcaaaaggattaatgcctgcatcatcatttctgcaataaaacaagaagctaagtggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgcatatgtactccaggtcaaggccacagatgcagatgacccgacctatggaaacagtgccagagtcgtttacagcattcttcagggacaaccttatttctctattgatcccaagacaggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaaaaagaaacacaaatattaatagaaatctctctcacacacacacacacacacaaacacacacacacacacacacactctgggacaagattcctttgattacctggtttctagtaagttactaaattaatcatattgtcagttttggtttattctgccaacaagagatacatcctataatgtgtacttgctttgttttgttgttttgttttttcacaatcacactgagacaagctcaggcctattcaatacaatttactgacatgacaacctagaacgaagatagctatgtggcatcacggtggaagagtgttagatttttcttaattccactaaagtgcctattgaaactcttatcatttaaagtggtgtacagtacactctgctgtgatggtattgcgggattcagagataaagacataaaacaaagacaccgtctttatgtcaagaagcaatagcgacactctgactctcctcattccttttgagaacaaaagaagaacactttctgatctccaccttcttctaattcaaaaggttttctttttcttttttaaactgtatgctaaaacgtatttgtttatcctatcctttcagaaaattgaaataaatatgaaaatatcaagttcaatatgtaagtcccaaattctagaaacaatgtttgatcttaacattagttcacattaaagctgttcattaaaatgttactttcttttccaaaaaaaaaagaaagaaaaaaaagaaaaaatattcctctttataaagagaggcctcagggctcaaattacacattaaaataaatattggttttgcttaatattgtactggtgtgtggaaaattggttttaacagtcaccagattcagcttttagtcatagatgtaatttcaagttgtgtttctatgaaaattcttagaagaaaaaagtgccattcatttaagcatggaaagagaaattcattatacagtttctcagagtttcttacaatctagtgattctttgatgagcagcaaaaataaaa

SEQ ID NO: 3993 - DNA, 3028 bp, Homo sapiens
tctttttatgttatttgcataattttatcctgcaaaagtgagagctgtcaaaaattaaccatttggggctttggcattcagttatgtgaccttttccagagagttagatctcttcagggaactaggaacttgatgaggaagtgctgagaaggtggtcagtggcagaaagagcggatgacggatggggaccagcagtgaggagctcaacataacagggaaaaggagcacaggatgcagctacttggagggtgttgattgaaaacttcgatctccccaccccattcacggttgatttgacggatttctcacctcgttcacagagaaaatttcaattaaggcccctttagatggaatataatacagcagaagccttttcatcaaaaggattaatgcctgcatcatcatttctgcaataaaacaagaagctaagtggtggaggccacagacacctcaaacctggattccacaattctacgttaagtgttggagtttttattactctgctgtaggaaagcctttgccaatgcttacaaggaactgtttatccctgcttctctgggttctgtttgatggaggtctcctaacaccactacaaccacagccacagcagactttagccacagagccaagagaaaatgttatccatctgccaggacaacggtcacatttccaacgtgttaaacgtggctgggtatggaatcaattttttgtgctggaagaatacgtgggctccgagcctcagtatgtgggaaagctccattccgacttagacaagggagagggcactgtgaaatacaccctctcaggagatggcgctggcaccgtttttaccattgatgaaaccacaggggacattcatgcaataaggagcctagatagagaagagaaacctttctacactcttcgtgctcaggctgtggacatagaaaccagaaagcccctggagcctgaatcagaattcatcatcaaagtgcaggatattaatgataatgagccaaagtttttggatggaccttatgttgctactgttccagaaatgtctcctgtgggtgttattagaacagctttgccaaacatggacagagaagtcaaagaacaatatcaagtactcatccaagccaaggatatgggaggacagcttggaggattagccggaacaacaatagtcaacatcactctcaccgatgtcaatgacaatccacctcgattccccaaaagcatcttccacttgaaagttcctgagtcttcccctattggttcagctattggaagaataagagctgtggatcctgattttggacaaaatgcagaaattgaatacaatattgttccaggagatgggggaaatttgtttgacatcgtcacagatgaggatacacaagagggagtcatcaaattgaaaaagcctttagattttgaaacaaagaaggcatacactttcaaagttgaggcttccaaccttcaccttgaccaccggtttcactcggcgggccctttcaaagacacagctacggtgaagatcagcgtgctggacgtagatgagccaccggttttcagcaagccgctctacaccatggaggtttatgaagacactccggtagggaccatcattggcgctgtcactgctcaagacctggatgtaggcagcagtgctgttaggtacttcatagattggaagagtgatggggacagctactttacaatagatggaaatgaaggaaccatcgccactaatgaattactagacagagaaagcactgcgcagtataatttctccataattgcgagtaaagttagtaaccctttattgaccagcaaagtcaatatactgattaatgtcttagatgtaaatgaatttcctccagaaatatctgtgccatatgagacagccgtgtgtgaaaatgccaagccaggacagataattcagatagtcagtgctgcagaccgagatctttcacctgctgggcaacaattctcctttagattatcacctgaggctgctatcaaaccaaattttacagttcgtgacttcagaaacaacacagcggggattgaaacccgaagaaatggatacagccgcaggcagcaagagttgtatttcctccctgttgtaatagaagacagcagctaccctgtccagagcagcacaaacacaatgactattcgagtctgtagatgtgactctgatggcaccatcctgtcttgtaatgtggaagcaatttttctacctgtaggacttagcactggggcgttgattgcaattctactatgcattgttatactcttagccatagttgtactgtatgtagcactgcgaaggcagaagaaaaaagacaccctgatgacctctaaagaagacatcagagacaacgtcatccattacgatgatgaaggaggtggggaggaagatacccaggctttcgacatcggggctctgagaaacccaaaagtgattgaggagaacaaaattcgcagggatataaaaccagactctctctgtttacctcgtcagagaccacccatggaagataacacagacataagggatttcattcatcaaaggctacaggaaaatgatgtggatccaactgccccaccatacgattcactggccacatatgcctacgaagggagtgggtccgtggcagagtccctcagctctatagactctctcaccacagaagccgaccaggactatgactatctgacagactggggaccccgctttaaagtcttggcagacatgtttggcgaagaagagagttataaccctgataaagtcacttaagggagtcgtggaggctaaaatacaaccgagaggggagatttttaaaaaagaaaaagaaacacaaatattaatagaaatctctctcacacacacacacacacacaaacacacacacacacacacacactctgggacaagattcctttgattacctggtttctagtaagttactaaattaatcatattgtcagttttggtttattctgccaacaagagatacatcctataatgtgtacttgc

SEQ ID NO: 3994 - DNA, 2847 bp, Homo sapiens
actcagcctggacgcgcttcttcgggtcgcgggtgcactccggcccggctcccgcctcggccccgatggacgccgcgttcctcctcgtcctcgggctgttggcccagagcctctgcctgtctttgggggttcctggatggaggaggcccaccaccctgtacccctggcgccgggcgcctgccctgagccgcgtgcggagggcctgggtcatccccccgatcagcgtatccgagaaccacaagcgtctcccctaccccctggttcagatcaagtcggacaagcagcagctgggcagcgtcatctacagcatccagggacccggcgtggatgaggagccccggggcgtcttctctatcgacaagttcacagggaaggtcttcctcaatgccatgctggaccgcgagaagactgatcgcttcaggctaagagcgtttgccctggacctgggaggatccaccctggaggaccccacggacctggagattgtagttgtggatcagaatgacaaccggccagccttcctgcaggaggcgttcactggccgcgtgctggagggtgcagtcccaggcacctatgtgaccagggcagaggccacagatgccgacgaccccgagacggacaacgcagcgctgcggttctccatcctgcagcagggcagccccgagctcttcagcatcgacgagctcacaggagagatccgcacagtgcaagtggggctggaccgcgaggtggtcgcggtgtacaatctgaccctgcaggtggcggacatgtctggagacggcctcacagccactgcctcagccatcatcacccttgatgacatcaatgacaatgcccccgagttcaccagggatgagttcttcatggaggccatagaggccgtcagcggagtggatgtgggacgcctggaagtggaggacagggacctgccaggctccccaaactgggtggccaggttcaccatcctggaaggcgaccccgatgggcagttcaccatccgcacggaccccaagaccaacgagggtgttctgtccattgtgaaggccctggactatgagagctgtgaacactacgaactcaaagtgtcggtgcagaatgaggccccgctgcaggcggctgcccttagggctgagcggggccaggccaaggtccgcgtgcatgtgcaggacaccaacgagccccccgtgttccaggagaacccacttcggaccagcctagcagagggggcacccccaggcactctggtggccaccttctctgcccgggaccctgacacagagcagctgcagaggctcagctactccaaggactacgacccggaagactggctgcaagtggacgcagccactggccggatccagacccagcacgtgctcagcccggcgtcccccttcctcaagggcggctggtacagagccatcgtcctggcccaggatgacgcctcccagccccgcaccgccaccggcaccctgtccatcgagatcctggaggtgaacgaccatgcacctgtgctggccccgccgccgccgggcagcctgtgcagcgagccacaccaaggcccaggcctcctcctgggcgccacggatgaggacctgcccccccacggggcccccttccacttccagctgagccccaggctcccagagctcggccggaactggagcctcagccaggtcaacgtgagccacgcgcgcctgcggccgcgacaccaggtccccgaaggcctgcaccgcctcagcctgctgctccgggactcggggcagccgccccagcagcgcgagcagcctctgaacgtgaccgtgtgccgctgcggcaaggacggcgtctgcctgccgggggccgcagcgctgctggcggggggcacaggcctcagcctgggcgcactggtcatcgtgctggccagcgccctcctgctgctggtgctggtcctgctcgtggcactccgggcgcggttctggaagcagtctcggggcaaggggctgctgcacggcccccaggacgaccttcgagacaatgtcctcaactacgatgagcaaggaggcggggaggaggaccaggacgcctacgacatcagccagctgcgtcacccgacagcgctgagcctgcctctgggaccgccgccacttcgcagagatgccccgcagggccgcctgcacccccagccaccccgagtgctgcccaccagccccctggacatcgccgacttcatcaatgatggcttggaggctgcagatagtgaccccagtgtgccgccttacgacacagccctcatctatgactacgagggtgacggctcggtggcggggacgctgagctccatcctgtccagccagggcgatgaggaccaggactacgactacctcagagactgggggccccgcttcgcccggctggcagacatgtatgggcacccgtgcgggttggagtacggggccagatgggaccaccaggccagggagggtctttctcctggggcactgctacccagacacagaggccggacagcctgaccctggggcgcaactggacatgccactccccggcctcgtggcagtgatggcccctgcagaggcagcctgaggtcaccgggcccgacccccctgggcctggggcagcctccttcctgtaggcgagggcccaagtctgggggcagaacctgagtgtggatggggcggccaggaagaggccccttcctgccggggtgggaagagtttctctccatcggccccatgcgggtcacctccctagtcccacctttgcctcctaccagtgaacctcatctttgtatgaaagacagcaacctcctgggtaaatctgaatgaaaaacgtgctagtctctttcatgca

SEQ ID NO: 3995 - DNA, 2694 bp, Homo sapiens
ttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatggg

SEQ ID NO: 3996 - DNA, 2526 bp, Homo sapiens
ttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggt

SEQ ID NO: 3997 - DNA, 2927 bp, Homo sapiens
ttttccactcctgagcaagcgtggctgaaccctcctacctgctcaagtgccctgccttgccccacccagcccagcctggccagagccccctggagaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggta

SEQ ID NO: 3998 - DNA, 2821 bp, Homo sapiens
gctcaagtgccctgccttgccccacccagcccagcctggccagagccccctggagaaggagctctcttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggactcaggcaaggcaactgagggcccatttgctatggatccagattctggcttcctgctggtgaccagggccctggaccgagaggagcaggcagagtaccagctacaggtcaccctggagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagcttggcctctggctccatctgagtcccctgggagagagcccagcacccaagatccagcaggggacaggacagagtagaagcccctccatctgccctggggtggaggcaccatcaccatcaccaggcatgtctgcagagcctggacaccaactttatggactgcccatgggagtgctccaaatgtcagggtgtttgcccaataataaagccccagagaactgggctgggccctatgggattggta

SEQ ID NO: 3999 - DNA, 2473 bp, Homo sapiens
cttcttgcttggcagctggaccaagggagccagtcttgggcgctggagggcctgtcctgaccatggtccctgcctggctgtggctgctttgtgtctccgtcccccaggctctccccaaggcccagcctgcagagctgtctgtggaagttccagaaaactatggtggaaatttccctttatacctgaccaagttgccgctgccccgtgagggggctgaaggccagatcgtgctgtcaggggagcaggcagagatgcaggatggacatgtcttgtggggtccacagcctgtgcttgtgcacgtgaaggatgagaatgaccaggtgccccatttctctcaagccatctacagagctcggctgagccggggtaccaggcctggcatccccttcctcttccttgaggcttcagaccgggatgagccaggcacagccaactcggatcttcgattccacatcctgagccaggctccagcccagccttccccagacatgttccagctggagcctcggctgggggctctggccctcagccccaaggggagcaccagccttgaccacgccctggagaggacctaccagctgttggtacaggtcaaggacatgggtgaccaggcctcaggccaccaggccactgccaccgtggaagtctccatcatagagagcacctgggtgtccctagagcctatccacctggcagagaatctcaaagtcctatacccgcaccacatggcccaggtacactggagtgggggtgatgtgcactatcacctggagagccatcccccgggaccctttgaagtgaatgcagagggaaacctctacgtgaccagagagctggacagagaagcccaggctgagtacctgctccaggtgcgggctcagaattcccatggcgaggactatgcggcccctctggagctgcacgtgctggtgatggatgagaatgacaacgtgcctatctgccctccccgtgaccccacagtcagcatccctgagctcagtccaccaggtactgaagtgactagactgtcagcagaggatgcagatgcccccggctcccccaattcccacgttgtgtatcagctcctgagccctgagcctgaggatggggtagaggggagagccttccaggtggaccccacttcaggcagtgtgacgctgggggtgctcccactccgagcaggccagaacatcctgcttctggtgctggccatggacctggcaggcgcagagggtggcttcagcagcacgtgtgaagtcgaagtcgcagtcacagatatcaatgatcacgcccctgagttcatcacttcccagattgggcctataagcctccctgaggatgtggagcccgggactctggtggccatgctaacagccattgatgctgacctcgagcccgccttccgcctcatggattttgccattgagaggggagacacagaagggacttttggcctggattgggagccagactctgggcatgttagactcagactctgcaagaacctcagttatgaggcagctccaagtcatgaggtggtggtggtggtgcagagtgtggcgaagctggtggggccaggcccaggccctggagccaccgccacggtgactgtgctagtggagagagtgatgccaccccccaagttggaccaggagagctacgaggccagtgtccccatcagtgccccagccggctctttcctgctgaccatccagccctccgaccccatcagccgaaccctcaggttctccctagtcaatgactcagagggctggctctgcattgagaaattctccggggaggtgcacaccgcccagtccctgcagggcgcccagcctggggacacctacacggtgcttgtggaggcccaggatacagatgagccgagactgagcgcttctgcacccctggtgatccacttcctaaaggcccctcctgccccagccctgactcttgcccctgtgccctcccaatacctctgcacaccccgccaagaccatggcttgatcgtgagtggacccagcaaggaccccgatctggccagtgggcacggtccctacagcttcacccttggtcccaaccccacggtgcaacgggattggcgcctccagactctcaatggttcccatgcctacctcaccttggccctgcattgggtggagccacgtgaacacataatccccgtggtggtcagccacaatgcccagatgtggcagctcctggttcgagtgatcgtgtgtcgctgcaacgtggaggggcagtgcatgcgcaaggtgggccgcatgaagggcatgcccacgaagctgtcggcagtgggcatccttgtaggcaccctggtagcaataggaatcttcctcatcctcattttcacccactggaccatgtcaaggaagaaggacccggatcaaccagcagacagcgtgcccctgaaggcgactgtctgaatggcccaggcagctctagctgggagctt

SEQ ID NO: 4000 - DNA, 3693 bp, Homo sapiens
ggaagagggagtgttcccgggggagatactccagtcgtagcaagagtctcgaccactgaatggaagaaaaggacttttaaccaccattttgtgacttacagaaaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccataaaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagagtttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctgaatttgaaaaggaatgtttgaatttatatagcaagtgctatttcagcaacaaccatctcatcctattacttttcatctaacgtgcattataattttttaaacagatattccctcttgtcctttaatatttgctaaatatttcttttttgaggtggagtcttgctctgtcgcccaggctggagtacagtggtgtgatcccagctcactgcaacctccgcctcctgggttcacatgattctcctgcctcagcttcctaagtagctgggtttacaggcacccaccaccatgcccagctaatttttgtatttttaatagagacggggtttcgccatttggccaggctggtcttgaactcctgacgtcaagtgatctgcctgccttggtctcccaatacaggcatgaaccactgcacccacctacttagatatttcatgtgctatagacattagagagatttttcatttttccatgacatttttcctctctgcaaatggcttagctacttgtgtttttcccttttggggcaagacagactcattaaatattctgtacattttttctttatcaaggagatatatcagtgttgtctcatagaactgcctggattccatttatgttttttctgattccatcctgtgtccccttcatccttgactcctttggtatttcactgaatttcaaacatttgtcagagaagaaaaacgtgaggactcaggaaaaataaataaataaaagaacagccttttcccttagtattaacagaaatgtttctgtgtcattaaccatctttaatcaatgtgacatgttgctctttggctgaaattcttcaacttggaaatgacacagacccacagaaggtgttcaaacacaacctactctgcaaaccttggtaaaggaaccagtcagctggccagatttcctcactacctgccatgcatacatgctgcgcatgttttcttcattcgtatgttagtaaagttttggttattatatatttaacatgtggaagaaaacaagacatgaaaagagtggtgacaaatcaagaataaacactggttgtagtcagtttt

SEQ ID NO: 4001 - DNA, 2625 bp, Homo sapiens
aatcacggtggaagtatgatattttggctgtggatctgagttgatcaatctgcttagtggacttgagtccccccacccccgcttgtctgattggggctcctgggaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccataaaagtgaaggacatcaacgacaatcgacccacgtttctccagtcaaagtacgaaggctcagtaaggcagaactctcgcccaggaaagcccttcttgtatgtcaatgccacagacctggatgatccggccactcccaatggccagctttattaccagattgtcatccagcttcccatgatcaacaatgtcatgtactttcagatcaacaacaaaacgggagccatctctcttacccgagagggatctcaggaattgaatcctgctaagaatccttcctataatctggtgatctcagtgaaggacatgggaggccagagtgagaattccttcagtgataccacatctgtggatatcatagtgacagagaatatttggaaagcaccaaaacctgtggagatggtggaaaactcaactgatcctcaccccatcaaaatcactcaggtgcggtggaatgatcccggtgcacaatattccttagttgacaaagagaagctgccaagattcccattttcaattgaccaggaaggagatatttacgtgactcagcccttggaccgagaagaaaaggatgcatatgttttttatgcagttgcaaaggatgagtacggaaaaccactttcatatccgctggaaattcatgtaaaagttaaagatattaatgataatccacctacatgtccgtcaccagtaaccgtatttgaggtccaggagaatgaacgactgggtaacagtatcgggacccttactgcacatgacagggatgaagaaaatactgccaacagttttctaaactacaggattgtggagcaaactcccaaacttcccatggatggactcttcctaatccaaacctatgctggaatgttacagttagctaaacagtccttgaagaagcaagatactcctcagtacaacttaacgatagaggtgtctgacaaagatttcaagaccctttgttttgtgcaaatcaacgttattgatatcaatgatcagatccccatctttgaaaaatcagattatggaaacctgactcttgctgaagacacaaacattgggtccaccatcttaaccatccaggccactgatgctgatgagccatttactgggagttctaaaattctgtatcatatcataaagggagacagtgagggacgcctgggggttgacacagatccccataccaacaccggatatgtcataattaaaaagcctcttgattttgaaacagcagctgtttccaacattgtgttcaaagcagaaaatcctgagcctctagtgtttggtgtgaagtacaatgcaagttcttttgccaagttcacgcttattgtgacagatgtgaatgaagcacctcaattttcccaacacgtattccaagcgaaagtcagtgaggatgtagctataggcactaaagtgggcaatgtgactgccaaggatccagaaggtctggacataagctattcactgaggggagacacaagaggttggcttaaaattgaccacgtgactggtgagatctttagtgtggctccattggacagagaagccggaagtccatatcgggtacaagtggtggccacagaagtaggggggtcttccttgagctctgtgtcagagttccacctgatccttatggatgtgaatgacaaccctcccaggctagccaaggactacacgggcttgttcttctgccatcccctcagtgcacctggaagtctcattttcgaggctactgatgatgatcagcacttatttcggggtccccattttacattttccctcggcagtggaagcttacaaaacgactgggaagtttccaaaatcaatggtactcatgcccgactgtctaccaggcacacagagtttgaggagagggagtatgtcgtcttgatccgcatcaatgatgggggtcggccacccttggaaggcattgtttctttaccagttacattctgcagttgtgtggaaggaagttgtttccggccagcaggtcaccagactgggatacccactgtgggcatggcagttggtatactgctgaccacccttctggtgattggtataattttagcagttgtgtttatccgcataaagaaggataaaggcaaagataatgttgaaagtgctcaagcatctgaagtcaaacctctgagaagctga

SEQ ID NO: 4002 - DNA, 637 bp, Homo sapiens
agtcgtagcaagagtctcgaccactgaatggaagaaaaggacttttaaccaccattttgtgacttacagaaagggtctcgctctgtcacccaggctgcagtgcagtggcgcaatcatggctggctgcaacctctgcctcctgggctcaagtgatcctcccacctcagcctcccaggaatttgaataaagaaaactatgatacttcaggcccatcttcactccctgtgtcttcttatgctttatttggcaactggatatggccaagaggggaagtttagtggacccctgaaacccatgacattttctatttatgaaggccaagaaccgagtcaaattatattccagtttaaggccaatcctcctgctgtgacttttgaactaactggggagacagacaacatatttgtgatagaacgggagggacttctgtattacaacagagccttggacagggaaacaagatctactcacaatctccaggttgcagccctggacgctaatggaattatagtggagggtccagtccctatcaccataaaagtgaaggacatcaacgacaatcgacccacgtttctccagtcaaagtacgaaggctcagtaaggcagaactctcgcccaggaaagcccttcttgtatg

SEQ ID NO: 4003 - DNA, 2885 bp, Homo sapiens
tttaagtactgcagtcatctaatgtacttcaccagcagaatctaaattctagatccaagaaagattattgtcagctggctttattcagggtccaattctgagcccagtatcaagtaataaagattgagtggtgtgataattagagatgcttcaaccaaagttttcaaaaatgggaacatattgaacccttggttctacaactaccttcttacaacgaagttagtatgcagtgctctccaagtcaataaggaaagtggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttag

SEQ ID NO: 4004 - DNA, 3087 bp, Homo sapiens
ggagcccagggctcgaggtgcgcggagcctgagtctgggctttccgaggacggcgagcagctgtgcccagagctctgggaaagtcccctctctttgcttcttataaattaagttcctttccaccagttagggcaagtccgccaagatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagtaaaaaaaaaaaaaaaa

SEQ ID NO: 4005 - DNA, 2386 bp, Homo sapiens
gaggacggcgagcagctgtgcccagagctctgggaaagtcccctctctttgcttcttataaattaagttcctttccaccagttagggcaagtccgccaagatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatca

SEQ ID NO: 4006 - DNA, 3542 bp, Homo sapiens
tagattgattatacagcagcagcatgagctgagtctcagagctgagcgagcgtcagggtgaaaaggaaagagagaaagagagagagagagaaaaaaaagcggggagagagagagagagaggaacacaaggtggggaggaagccagtgcacgttccatagcatcactactgtgactgcttgtacccgataatcttgctctgcagctccctcagtgaacaacttactgaggtgcctttctttttacaagaggatgtcagctctgagctccagcaagaaataacagacttcaccttggaatagctcatcttactcctgcatcattaaagcggattttcaaaagaaaacaaaaatcaagtcccctttccagttccactttcttccagcattgaacaggaacagtttcacgctccaggactcaaccacagcaatatgtaagaagaacacacaccaaacattcctgaagtgatttaaaagatggaatctcgctctgtctcccaggctggagtgcagtggcgcaatctcagctcattgcaacctccacctcctgggttcacgccattctcctgcctcagcctcctgagtagctgggactacaggcgcccgccaccacgccaggatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagt

SEQ ID NO: 4007 - DNA, 3544 bp, Homo sapiens
tagattgattatacagcagcagcatgagctgagtctcagagctgagcgagcgtcagggtgaaaaggaaagagagaaagagagagagagagaaaaaaaagcggggagagagagagagagaggaacacaaggtggggaggaagccagtgcacgttccatagcatcactactgtgactgcttgtacccgataatcttgctctgcagctccctcagtgaacaacttactgaggtgcctttctttttacaagaggatgtcagctctgagctccagcaagaaataacagacttcaccttggaatagctcatcttactcctgcatcattaaagcggattttcaaaagaaaacaaaaatcaagtcccctttccagttccactttcttccagcattgaacaggaacagtttcacgctccaggagctcaagaccataaataattttgtagcagcaaacaatacacttttatgtatttattgagaaggtggagtctcgctctgtctcccaggctggagtgcagtggcgcaatctcagctcattgcaacctccacctcctgggttcacgccattctcctgcctcagcctcctgagtagctgggactacaggcgcccgccaccacgccaggatagactgaagaggagcaagaacagaaacagggagccagttacagatctatcccaagaattctggggagagatgatggtgtctgcagcagagtgacagcagtggagattgagagaaaaggttgaaaatggttgcttgtgttcaactactgtgaagagttggaatcagacaactacggctttgattttccaagtggttcagaatgtaaatatgatctgacctttccctgatggacagttaaatcatggacacgctaaacaatttactttggactgtccttcctaaagatgctctggcttctctcttgaatgctcactaagctttcgtagctgacaaggaaaggaaggaaaactgtgaactggaaagttatcttacaatgaaaattactagcacatcttgcatctgtccagtcctagtgtgtctctgttttgtgcagaggtgttatggaactgctcaccacagctccatcaaggtgatgagaaaccaaaccaaacacattgaaggtgaaaccgaagtccatcatcgtcccaaaaggggatgggtatggaatcagttctttgttttagaagaacatatgggaccagatcctcagtatgttggaaagctgcactccaattctgacaaaggtgatggatctgtcaagtacatccttactggagagggtgctgggactatatttatcattgacgataccacgggtgatatccactcaacaaaaagcctagacagagagcagaagacccactatgtgcttcatgctcaagctattgatagacgtacaaacaaacctcttgagcctgaatccgagttcatcatcaaagtgcaagacatcaatgacaacgctccaaaattcacagatggaccatacattgttactgtgcctgaaatgtcagatatgggtacctctgttctacaggtgacagctactgatgcagatgaccctacctatggaaacagcgctcgggtggtttacagcattctccaaggacaaccctacttctccgtcgaccctaaaacaggagttattagaacggccttacataacatggacagagaagccagagaacattactccgtagtcattcaagccaaagacatggctgggcaagttggagggctttcaggatctacaacagtcaacatcaccttaaccgatgtcaatgacaacccaccacgctttcctcaaaaacactatcagctatatgttcctgagtcagctcaagttggttcagctgttgggaaaatcaaggcaaatgatgctgacactggctcaaatgctgacatgacctactccatcataaatggtgatggcatgggaatattctcaatctccactgacaaagagaccagagaaggaatcctttctttaaagaagccactgaactatgagaaaaagaagtcatataccctcaacatagaaggagcaaatacacatcttgattttcgcttttctcacttgggtccttttaaagatgctactatgctgaagatcattgttggggatgtagatgaaccaccactattttccatgccttcctacctcatggaagtctacgaaaatgccaagattgggaccgtcgttggtacagttttggcacaagatcctgacagtactaacagcttagtaagatacttcatcaactacaatgttgaagacgacagatttttcaacattgatgccaatactgggaccattaggactacaaaggttctcgacagagaagaaactccatggtacaacatcacagtcactgcttcagaaattgataatcctgatttgctgagccatgtcacagtgggtattagagttctggatgtcaatgacaatccacccgaacttgccagggaatatgatattattgtatgtgaaaattctaagcctggccaggttattcataccatcagtgccactgataaagatgattttgccaatggaccaaggtttaacttctttcttgatgaacgcctgcctgtaaatccaaacttcactctgaaggacaatgaagataacacagccagcattctgacaaggcggaggagatttagtcgaactgttcaggatgtgtattatctgcccattatgatctctgatggtggaatcccctctctcagcagcagcagcaccctcaccatcagggtttgtgcatgcgagagagatgggcgtgtgcggacctgccatgcagaagccttcctgtcctcggctggtttgagtacaggagccttaatcgctattcttctctgtgttctcattctcctggcaattgtggtactttttatcaccctgaggcgcagcaaaaaagagcccttgatcatttcagaagaggatgtacgggagaacgtggtcacctatgatgatgaaggaggcggagaggaagacacagaggcctttgacatcacagccttgaggaatccttctgctgctgaggagctcaagtaccggagggatatcagacctgaagtgaagctcactcccagacaccagacatcatccaccctggaaagcatagatgttcaggaatttattaagcaaagactggcagaagcagacctagaccctagcgttcccccttatgactctcttcagacttatgcctatgagggtcagagatcagaagctgggtctatcagctcgctggattcagcaacgacacaatcagaccaggattatcactaccttggagactggggacccgagtttaaaaagttagctgaactctatggagaaatagaatctgaaagaacaacttagggggtcagttcttgcaaccttgtggaatttgcttcctgagtaagtggatatacaacctcagcaatgacaaggaagaagtgtggaaacagtacttggaactgaggaagctggacacagctcctgtagaaacaagtgcccttttcatgatcgaaactgggttatttaattggaagaaagt

SEQ ID NO: 4008 - DNA, 6341 bp, Homo sapiens
tgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgtttcctttatttaaaaaaaaaaaaaaaaaaaaagaatgctaggtaatcttcgtagaaaactagaaagtatgataaacaacagttggaggaatccatggaaaatagacgagaaaatgtaaataaggctttctggggatcacagaacttttgtatgaataaaagccttataaaaccagctctggcatatgactaaaatattcctctactatttttcaatgtcatctaatgcaaacgctcaacctttttaaatggttaatgtgagaaaggcactgaattaagatatcttagtgttattttatttactcaattttcatctttcacactgtaagaataaaatgtttttgtggttaagttcctgatactatatagagataaactttaaaactttaacacctaggataatgtgggtgattacataaatgtttaaaaacatttaccttatatggaaagcagatttctgactaagatgccatgattcattctagtttgatattttaaaactttgccaagagcactctttaaaactgatttcaaatttgaacagatacttggtgtatacaaattaatcagagttatatagtataaatttgtattatttttgatattacaactttgtattaaaaaggaaaatatatttaggtgtttgtcatagattttttttcatatgcaactcaaaacacattcttatgtcaaaatacaatagcaaaatacaagtcaatatttactcataattaaatgcaaactttatgaaactggtggaaagtgtggaaaaatttaagtaaatttttacctctactaaaaattatttagacaacttaaaggaatactggattcaaacttcagttactattcactgtaaatattatgatcaactgaactgacttaccattcatgggataaaacatgatacaattctcagtatttgcttttctgttaagagcttggaatatgactgatgcttcagtgtcatttttttattattgaatataaaattaggtgcaatagatacatttattgtagccttaagaaggaaatcaatgctaagctgttgggcataaaactttacagtaacattagataacaagataataaaacactttaattttaatcgaccttttaagaatgatctttattattctatccaaatcaaggtagacttcaaaatttatggtttgaacaggaagaaagtagtgaatacaaaattcttaaaattggttcatatgatcatttttttattaatagcatgtgagactaagctgaaccaaactggccatatatgttaaatcaaataatttgagtaattttgaaatattgatgaagtagttaaatggttataatatattttattggtactttgaaatttaaacatctatatcacataataaagaaagtttttcatcaatctgaaacaggcaccattaaattggtgacacaaatattatcatttcacaaaagcttgagaaaaccagatttgaagtgaaataatttaggaagatattaaaagtggatgagaggacataagatgtagtcaatccttaacgcaatgataccattattaggaaagaggaaaaataccaaacaagagaaaatttaaaggagcaaaaatttgcaagtcaaatagaaatgcacaaatcgagagaacatttacatttctatcacattgacatgaaaattgaaaatgtatagtcagagaaattttcatgaattattccatgaagtgttgtttcctttatttaaaaagaatgctaggtaatcttagtagaaaactaaaaagtatgataaacaacagatggaagaattcatggaaaatagacgagaaaaagtaaataaggctttctggagatgacggaaattttgtatgaataaaagccttataaacaatgaatacatttggataaacaactcattaaaatgcacattaatggaatacctgtacaaatagttttaatacttgtgtccagtggcactaaagagatatattaaaatagattctggttgagttgattataagattgtcaatcataggatacacagggaaagcacagacacgattgctcatctctttggtagtctaaaatatgttccttttaaccacatcaaaagatactatctgattctaatacagaaggtgcaacttcctaggaattatactttgtattatattcaataattattttatgttttgcatcacatgggtgttgcaagaacacagctcttaaactaaaaaggcattacattaagaatttatttttgtaaattttaataaactctaaattaatgcaaaatatttatgaaaatagcacagcttcacattaatacccacagtacttaaatatctcccttagttgactcacagctttgtatgtaagcttcaaatttttaatggtaaaaataagaaaattaggactagcgaactgctagttgttccctcagtgcatgtgcttgagcctaacagatctttgtttgaattagttactttcaattaagcgaacatataatatttgttaaactgcttaatctttccagatctcactttgtaaaatgacgtccaatcaacctatttcacatggttgttatgaagaattaataataagatatgtaaaaccagcagcaccaatagtgcctgacaaaatataactgctcaataaataacagtgaattattataacaacagctaatggtattctattggaacacatggtctgtttcttttccaattctgagtgatctcaacagcctcacggcacattgaaaataaaagtcaacttcctcaccttccccataggccatggactttcccatctctacccacttgtgcagtttctcctctttcctctctcctcctcagttactaaagcaatcttccttcaaacacttctattttccattacatcacttcattcaggttggtgatcagctgcaacttcctcagaaagaccactgctgcttccagtgaccctggctttgtcttgctttgtattagattactcagctccctggtattattgttgtctttatcgcttattagaatgtaacccttaatgggcaagaaattgtcagtcttgttcatttatcatcgtataaaaaatgtttctagcacacagaaagtgaccaataaatatttctggaattaatgtagtaatgaatccaatctattttacttagtgacttgtagaaattcttttggtttccattgactatttttatagaatattaatatggaattaaagtatttttcaaaa

SEQ ID NO: 4009 - DNA, 1892 bp, Homo sapiens
agagaacccaaaatagcattgagtaagcagtgacatactgacagtgttgtggtactaaaagcacaagcgtctgtaactctgggcaatggggcacatcgagagtttgctgagaagactgtgaagcaaaaagaagaaagtttttcctactcttccttatgtgtccaacacgaagtttgctgttcagttttcacagaacttctagaagttgaagttacaaaggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatgatatagggatgctgtattccttgaagattacatttcaaagagatggtcaccattacttgataaatacaatcctggatcctaaagcttccaagaaacttgttgaacttttgaaagatttccatacgcttcaaagggacaaagaaaaaacttacatacaaagctttttttttccctctctctctctctttctctgtgtgtgtgtgtgtgtgtgtgtgtgtgtgtatgaatgctctgagaaaaggaaggaaagaaaaaatattttcccttgctttcaacaagtacaaggcctctaatttttaatttgttttgttctttcaaattatcattgcaaatagtacatatattttaaataaaaacactaaaacaaact

SEQ ID NO: 4010 - DNA, 1963 bp, Homo sapiens
aatggggcacatcgagagtttgctgagaagactgtgaagcaaaaagaagaaagtttttcctactcttccttatgtgtccaacacgaagtttgctgttcagttttcacagaacttctagaagttgaagttacaaaggtatatagaaggtacacagaatcagaaaagattataaaagaaagcaagatttttgttagtgacgtcctgtttcctctgaagagtaatagttggaatcaaaagagtcaacgcaatgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcagggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattca

SEQ ID NO: 4011 - DNA, 3496 bp, Homo sapiens
cctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggcgccctcattgccatcctcgcctgcatctttgtcctcttagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccgcccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtgacggaagccaggaggcaggcgcgcgtccaaatccagacgttctccgcgggtgcttcgcggacaaggtgcagccaaccacacgagcaatactgtgctggagagtgagaatgggggtgagcaggcgaacagagctctctctggatcagctttacttgggtagattaagttaaataagcaaaaggaaacccagaaggaagagggcagaatctttaattacctttttttcttttctttttgatttttctgacactgtgtgcgaaggcttggagtccaaggtgttctgacaagggtggcttttctctgccattcgctaaggcctttgtcacttttccaccacagaaaggctctggccttggatacagagatgccaattgaaagcagaaagttctactctcgtatctgttttttatcttatcttattctccatttaagagttttgctggctcaaaccacagaaaccaacccacaagaaagaacaaaaaacttgttactcagtgaaattaacctacttgttctgggatggatggaatttcccgtaacccttttgagacaaggttaagactgaatcagccttgcatgggggtggatgggtgggagggtgggtgaaggaagagacattgactttatgctcaagtttagtggctgaaccaagagatgttggcattacagctcatccaacgccatcaagttagagtgctcgtgtctcctctcagctatttaactgtgcccctgcaaaattgttcagaatgaaaccagaaaaatctgcctcttttgcactgtagatgtctcttccatgtgccaaatgtggagattagatgctacaaatgaaagccaaataaaaaagaagtatctgacaaaagcatgggttagagggctttcctaatctgtgtgaggtcaatccaagggatgtttacatactgtagataacctacttgaacaaaaatcagtattatagagaataaatggatgtaagaaaattacatgtacaagttttgtatatttgttaataattttggtaataaatatgatgtactgcatctcagtaccttagcacttcttttaataaaagttaaatagaa

SEQ ID NO: 4012 - DNA, 2904 bp, Homo sapiens
agctacgtgagcagaacgcccgccctggagcagttaggaccgaaggtctccggagagtcgccggcggtgccaggaagtcaacttcaagcagattgacttgaaacgggatctcatttaggaagcataagtgtccaatcaaaaactgtgtatttttttaaatttggaaaatactcaagttccagttgcttatcattctccttcattttctgaaaacctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggcgccctcattgccatcctcgcctgcatctttgtcctcttagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccgcccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtgacggaagccaggaggcaggcgcgcgtccaaatccagacgttctccgcgggtgcttcgcggacaaggtgcagccaaccacacgagcaatactgtgctggagagtgagaatgggggtgagcaggcgaacagagctctctctggatcagctttacttgggtagattaagttaaataagcaaaaggaaacccagaaggaagagggcagaatctttaattacctttttttcttttctttttgatttttctgacactgtgtgcgaaggcttggagtccaa

SEQ ID NO: 4013 - DNA, 2683 bp, Homo sapiens
gatgtgcgccgggaaggggaccagagagccaggctccggggaggcgcaggcacctacggggccgatccctggtccgtgcctcgcgccgcgcccccgccggagctcggctgtgggaggagaatgtggaagtcaacttcaagcagattgacttgaaacgggatctcatttaggaagcataagtgtccaatcaaaaactgtgtatttttttaaatttggaaaatactcaagttccagttgcttatcattctccttcattttctgaaaacctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggcgccctcattgccatcctcgcctgcatctttgtcctcttagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccgcccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtga

SEQ ID NO: 4014 - DNA, 3661 bp, Homo sapiens
aggctcctgatggaaagggaaggcccctagtcctggcaggatctgccggccccaacccgcatcctttctgcgcaggaaccatggcgcttccccgactctggagctgtccaggtgctgcctggtgatccgcacgcgacgcggcgacgggggcgcgggcgggcaccccgggggctgtccatgccccggatgcggccgcgccccctccccctccagccgggtacccccgcggctgggcggcgttcagggccgcgggcccgtccgggtgccccgtcgggggcgacatcccggcggccgcgctgaggccaccatgtgacacggcgccgcatcgttgtgcgaccaagcagcggcgccctggtgcctctcgtccatgctcctgggccccagccccgcgcaggccaaggatgaggccgaggcccgaaggtagggggctccgggcgggagtcgcgctgtcccccgcgctactgctgctgctgctgctgccgccgccgccgacgctgctggggcgcctgtgggcagcgggcacaccctcgccgtcggcgcccggagctcggcaggacggcgcgctgggagccggccgcgtcaaacgcggctgggtgtggaaccagttcttcgtggtagaggagtacacgggcacggagcccctgtatgtgggcaagatccactccgactcagacgagggtgacggggccatcaagtacaccatctcaggcgagggtgctgggaccatcttcctgatcgacgagctgacaggcgacattcatgccatggagcgcctggaccgcgagcagaaaaccttctacacgctgcgggcccaggctcgggatcgcgccaccaaccgcctactggagcccgagtcggagttcatcatcaaggtgcaggacatcaatgacagtgagccccgcttcctgcacggcccctatattggcagcgtggccgagctctcacctacaggcacgtcggtgatgcaggtgatggcctcggatgcggatgaccccacgtacggcagcagcgctcggctggtgtacagcgtgctggacggcgagcaccacttcaccgtggaccccaagaccggcgtaatccggacggctgtgcctgaccttgaccgcgagagccaggagcgctacgaggtggtgatccaggccacagacatggcgggtcagctgggtggcctctcgggctccactaccgtcaccatcgtagtcaccgacgtcaatgacaacccgccccgtttcccgcagaagatgtaccagttcagcatccaggagtcagcccccattggaacggctgtgggacgtgtgaaggctgaggactcagacgtgggagagaacacagacatgacttaccaccttaaggacgagagcagcagcggcggcgatgtgttcaaggtcaccacagacagcgacactcaggaggccatcatcgtagtgcagaagcgcctggacttcgaatcccagcccgtgcacaccgtgatcctggaggccctcaacaagttcgtggacccccgcttcgccgacctgggcacgttccgcgaccaggcgatcgtgcgcgtggccgtgaccgacgtggacgagccccccgagttccggccgccctccggcctcctggaggtgcaggaggacgcgcaggtgggctccctggtcggcgtggtgacggcgcgggaccccgacgccgccaaccggcccgtccggtacgccattgaccgcgaatcagatttggaccagatcttcgatatcgatgcggacacaggcgccatcgtgactggcaaggggctggaccgcgagacggccggctggcacaacatcacagtgctggccatggaggcggacaatcatgcacagctatcccgggcatccctaaggatccgaatcctggatgtgaacgacaatcccccagaactggccacaccctacgaggcagctgtatgcgaggatgccaagccaggccagctcatccagaccatcagcgtggtggacagagacgagccccaaggcgggcaccgcttctatttccgcctggtgcctgaagctcccagcaaccctcatttctctctgcttgacatccaagacaacaccgctgcagtgcacacgcagcacgtgggcttcaaccggcaggagcaggacgtgttcttcctgcccatcctggtggtagacagtgggccgcccacactgagcagcacaggcacgctcaccatccgcatctgtggctgcgacagctccggcaccatccagtcctgcaacaccacggcctttgtcatggccgcctccctcagccccggcgccctcatcgccctcttggtctgcgttctcatcctggttgtgctggtgctgctgatcctcaccctcaggcgccaccacaagagccacctgagctcggacgaggatgaagacatgcgggacaacgtcatcaaatacaacgacgaaggcggcggcgagcaggacaccgaagcctacgacatgtcggcgctgcggagcctctacgacttcggcgagctcaagggcggcgacgggggcggcagcgcgggcgggggagcgggcgggggctcgggcgggggcgcgggcagccccccgcaggcccacctgccctccgagcgccactcgctgccgcaggggccgccgagccccgagccagacttctcagtgttcagggacttcatcagccgcaaggtggcactggcggacggggacctgtcggtgccgccctacgacgccttccagacctacgccttcgagggcgcggactcgccggccgcctcgctcagctccctgcacagcggctcgtcgggctccgagcaggacttcgcctatctcagcagctggggtccgcgcttccggcccctggccgcgctctacgccggccaccgcggggacgacgaggcccaggcctcctagcccctcgccctgccgtcggggcgcggctgctcacccgcccagcacacgccggggccccaggacaacgcgtttcccccgcggaccccctttcctgccctcccccaaccctcccttggcggctggacggaggggggacttgctaggagcggactcttccattcctcctcctctaggggtgcagctttggagcccagaggtgcgggattctgaccaacggcattaaaactgaggcgagaccgggcacggtgtggctctggggttagaatgggagatgggggtggcgttgcagagtcgggaaggggcgggtcactcaatcctggcctgggggagaatgctggagggagcacgccgctgagatgcccccaccccaggtttcccccatcagagttaagaggaaagaaggctgttcacttactaagcacctactgtgtgctgggacgctgtacagagaccagctcagtcgtcagagaaaccatgaggtggtgtcctgcacggaatagaaggggaaaggaccccagagaagtggctgtgacccgtccaagggcacctggccagtgaatggcagagcctctggcactgaccagctgcctggcctcgggcaagtcacttcacttctctggtcctcagtttcctcatctgtcaaatggggttaataacagaacctacctcgaagagttgtgaggctaaaaagggttcatatgtgtcaagtggttaggacagtgcctggcacatagtaggtgttcaataaatgctagcctttgttactattctta

SEQ ID NO: 4015 - DNA, 3249 bp, Homo sapiens
agacacgcacactccctcgctcccgctcgctcgctcactccctcgctctctcgctctctcgctctctcgctcacacacacgcgcgcacacgccgccgcggctccccctctcgctcccgctctccctccggctcctgcgggcggccgcggggctccggactcgcccgctgcccgcgccggggctcccgccccacgcagcgtcccgaggcggcaggactagggggagccccgggccgctccccgaggctcctgatggaaagggaaggcccctagtcctggcaggatctgccggccccaacccgcatcctttctgcgcaggaaccatggcgcttccccgactctggagctgtccaggtgctgcctggtgatccgcacgcgacgcggcgacgggggcgcgggcgggcaccccgggggctgtccatgccccggatgcggccgcgccccctccccctccagccgggtacccccgcggctgggcggcgttcagggccgcgggcccgtccgggtgccccgtcgggggcgacatcccggcggccgcgctgaggccaccatgtgacacggcgccgcatcgttgtgcgaccaagcagcggcgccctggtgcctctcgtccatgctcctgggccccagccccgcgcaggccaaggatgaggccgaggcccgaaggtagggggctccgggcgggagtcgcgctgtcccccgcgctactgctgctgctgctgctgccgccgccgccgacgctgctggggcgcctgtgggcagcgggcacaccctcgccgtcggcgcccggagctcggcaggacggcgcgctgggagccggccgcgtcaaacgcggctgggtgtggaaccagttcttcgtggtagaggagtacacgggcacggagcccctgtatgtgggcaagatccactccgactcagacgagggtgacggggccatcaagtacaccatctcaggcgagggtgctgggaccatcttcctgatcgacgagctgacaggcgacattcatgccatggagcgcctggaccgcgagcagaaaaccttctacacgctgcgggcccaggctcgggatcgcgccaccaaccgcctactggagcccgagtcggagttcatcatcaaggtgcaggacatcaatgacagtgagccccgcttcctgcacggcccctatattggcagcgtggccgagctctcacctacaggcacgtcggtgatgcaggtgatggcctcggatgcggatgaccccacgtacggcagcagcgctcggctggtgtacagcgtgctggacggcgagcaccacttcaccgtggaccccaagaccggcgtaatccggacggctgtgcctgaccttgaccgcgagagccaggagcgctacgaggtggtgatccaggccacagacatggcgggtcagctgggtggcctctcgggctccactaccgtcaccatcgtagtcaccgacgtcaatgacaacccgccccgtttcccgcagaagatgtaccagttcagcatccaggagtcagcccccattggaacggctgtgggacgtgtgaaggctgaggactcagacgtgggagagaacacagacatgacttaccaccttaaggacgagagcagcagcggcggcgatgtgttcaaggtcaccacagacagcgacactcaggaggccatcatcgtagtgcagaagcgcctggacttcgaatcccagcccgtgcacaccgtgatcctggaggccctcaacaagttcgtggacccccgcttcgccgacctgggcacgttccgcgaccaggcgatcgtgcgcgtggccgtgaccgacgtggacgagccccccgagttccggccgccctccggcctcctggaggtgcaggaggacgcgcaggtgggctccctggtcggcgtggtgacggcgcgggaccccgacgccgccaaccggcccgtccggtacgccattgaccgcgaatcagatttggaccagatcttcgatatcgatgcggacacaggcgccatcgtgactggcaaggggctggaccgcgagacggccggctggcacaacatcacagtgctggccatggaggcggacaatcatgcacagctatcccgggcatccctaaggatccgaatcctggatgtgaacgacaatcccccagaactggccacaccctacgaggcagctgtatgcgaggatgccaagccaggccagctcatccagaccatcagcgtggtggacagagacgagccccaaggcgggcaccgcttctatttccgcctggtgcctgaagctcccagcaaccctcatttctctctgcttgacatccaagacaacaccgctgcagtgcacacgcagcacgtgggcttcaaccggcaggagcaggacgtgttcttcctgcccatcctggtggtagacagtgggccgcccacactgagcagcacaggcacgctcaccatccgcatctgtggctgcgacagctccggcaccatccagtcctgcaacaccacggcctttgtcatggccgcctccctcagccccggcgccctcatcgccctcttggtctgcgttctcatcctggttgtgctggtgctgctgatcctcaccctcaggcgccaccacaagagccacctgagctcggacgaggatgaagacatgcgggacaacgtcatcaaatacaacgacgaaggcggcggcgagcaggacaccgaagcctacgacatgtcggcgctgcggagcctctacgacttcggcgagctcaagggcggcgacgggggcggcagcgcgggcgggggagcgggcgggggctcgggcgggggcgcgggcagccccccgcaggcccacctgccctccgagcgccactcgctgccgcaggggccgccgagccccgagccagacttctcagtgttcagggacttcatcagccgcaaggtggcactggcggacggggacctgtcggtgccgccctacgacgccttccagacctacgccttcgagggcgcggactcgccggccgcctcgctcagctccctgcacagcggctcgtcgggctccgagcaggacttcgcctatctcagcagctggggtccgcgcttccggcccctggccgcgctctacgccggccaccgcggggacgacgaggcccaggcctcctagcccctcgccctgccgtcggggcgcggctgctcacccgcccagcacacgccggggccccaggacaacgcgtttcccccgcggaccccctttcctgccctcccccaaccctcccttggcgg

SEQ ID NO: 4016 - DNA, 3702 bp, Homo sapiens
ggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaggtgcctggggagtgaactgttttctaaa

SEQ ID NO: 4017 - DNA, 3487 bp, Homo sapiens
tgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgaggggaggggagagaggggctcacagagaggaaatggaggcttgcagctggcaagaggcaggacccgccgctcctaa

SEQ ID NO: 4018 - DNA, 2746 bp, Homo sapiens
gcggtgctcaaaggggcaagagctgagcggaacaccggcccgccgtcgcggcagctgcttcacccctctctctgcagccatggggctccctcgtggacctctcgcgtctctcctccttctccagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgt

SEQ ID NO: 4019 - DNA, 3038 bp, Homo sapiens
cggcggggaagatgaccgcgggcgccggcgtgctccttctgctgctctcgctctccggcgcgctccgggcccataatgaggatcttacaactagagagacctgcaaggctgggttctctgaagatgattacacggcattaatctcccaaaatattctagaaggggaaaagctacttcaagtcaagttcagcagctgtgtggggaccaaggggacacaatatgagaccaacagcatggacttcaaagttggggcagatgggacagtcttcgccacccgggagctgcaggtcccctccgagcaggtggcgttcacggtgactgcatgggacagccagacagcagagaaatgggacgccgtggtgcggttgctggtggcccagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgttttta

SEQ ID NO: 4020 - DNA, 3310 bp, Homo sapiens
atcttgggcctgtcacttggggagcactgtagaaggttctggagaaggcattgagactataattctactttaatgagctgggctacctagattctatggtacagcaagagaagctgtttgtatgcacctgtatgtacgtgccttacttaaaattcagaaagaaaatcttcaggtgccagaattacttgtgaggctggtgaagagtgaaaagccacttcccaggccagacaggaaagagtgccctggttgggaccagacgggcctggctgcagacgtacactttgggcttcagcagccctggtgctgccttgagcttgacccgaattgcttcttcccagaggctgggtctccctcgcagcccctgctctcaaggatgggaatgagaaggtcgatgacaaggcacctctgctttacatccaagcgttgacttttgtggcttcctttaccccattgctctgccctttaaagggtcctggtgtgtttgggaatgggacagacaattttgtttttcacaatggtattgggctgtggatccagaactcaagttccagaggaaagcgatgccaaagtcaacagggatgcttcacggaggcagggaaaatgcaggagtcaagttcagcagctgtgtggggaccaaggggacacaatatgagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgttttt

SEQ ID NO: 4021 - DNA, 3100 bp, Homo sapiens
ttcttctttctccctctgccttaatgatgctgcccctttcctgttcctggttgaagctgaagcccgcttcccttcgccgcacacaacacaggagcaatcttctcagccgtgcactcacagcttggaaaataaagggaggaaggagtcccagccacagggtagaggaacggcctctccacagagaagctgctgctgctgagctgaagtgacagtcaagttcagcagctgtgtggggaccaaggggacacaatatgagaccaacagcatggacttcaaagttggggcagatgggacagtcttcgccacccgggagctgcaggtcccctccgagcaggtggcgttcacggtgactgcatgggacagccagacagcagagaaatgggacgccgtggtgcggttgctggtggcccagacctcgtccccgcactctggacacaagccgcagaaaggaaagaaggtcgtggctctggacccctctccgcctccgaaggacaccctgctgccgtggccccagcaccagaacgccaacgggctgaggcggcgcaaacgggactgggtcatcccgcccatcaacgtgcccgagaactcgcgcgggcccttcccgcagcagctcgtgaggatccggtccgacaaagacaatgacatccccatccggtacagcatcacgggagtgggcgccgaccagccccccatggaggtcttcagcattgactccatgtccggccggatgtacgtcacaaggcccatggaccgggaggagcacgcctcttaccacctccgagcccacgctgtggacatgaatggcaacaaggtggagaaccccatcgacctgtacatctacgtcatcgacatgaatgacaaccgccctgagttcatcaaccaggtctacaacggctccgtggacgagggctccaagccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggaccgagagaaagttcagcagtacacagtcatcgttcaggccacagatatggaaggaaatctcaactatggcctctcaaacacagccacagccatcatcacggtgacagatgtgaatgacaacccgccagaatttaccgccagcacgtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggcagtcgactacgagctcaacagagctttcatgctgacagtgatggtgtccaaccaggcgcccctggccagcggaatccagatgtccttccagtccacggcaggggtgaccatctccatcatggacatcaacgaggctccctacttcccctcaaaccacaagctgatccgcctggaggagggcgtgccccccggcaccgtgctgaccacgttttcagctgtggaccctgaccggttcatgcagcaggctgtgagatactcaaagctgtcagacccagcgagctggctgcacatcaatgccaccaacggccagatcaccacggcggcagtgctggaccgtgagtccctctacaccaaaaacaacgtctacgaggccaccttcctggcagctgacaatgggatacccccggccagcggcaccgggaccctccagatctatctcattgacatcaacgacaacgcccctgagctgctgcccaaggaggcgcagatctgcgagaagcccaacctgaacgccatcaacatcacggcggccgacgctgacgtcgaccccaacatcggcccctacgtcttcgagctgccctttgtcccggcggccgtgcggaagaactggaccatcacccgcctgaacggtgactatgcccaactcagcttgcgcatcctgtacctggaggccgggatgtatgacgtccccatcatcgtcacagactctggaaaccctcccctgtccaacacgtccatcatcaaagtcaaggtgtgcccatgtgatgacaacggggactgcaccaccattggcgcagtggcagcggctggtctgggcaccggtgccatcgtggccatcctcatctgcatcctcatcctgctgaccatggtcctgctgtttgtcatgtggatgaagcggcgagagaaggagcgccacacgaagcagctgctcattgaccccgaggacgacgtccgcgacaacatcctcaagtatgacgaggaaggcggtggcgaggaggaccaggactacgacctcagccagctgcagcagccggaagccatggggcacgtgccaagcaaagcccctggcgtgcgtcgcgtggatgagcggccggtgggcgctgagccccagtacccgatcaggcccatggtgccgcacccaggcgacatcggtgacttcatcaatgagggactccgcgctgctgacaacgaccccacggcacccccctatgactccctgctggtcttcgactacgaggggagcggctccaccgcaggctccgtcagctccctgaactcatccagttccggggaccaagactacgattacctcaacgactgggggcccagattcaagaagctggcggacatgtatggaggtggtgaagaggattgactgacctcgcatcttcggaccgaagtgagagccgtgctcggacgccggaggagcaggactgagcagaggcggccggtcttcccgactccctgcggctgtgtccttagtgctgttaggaggccccccaatccccacgttgagctgtctagcatgagcacccacccccacagcgccctgcacccggccgctgcccagcaccgcgctggctggcactgaaggacagcaagaggcactctgtcttcacttgaatttcctagaacagaagcactgtttttaaaaaaaaaaaaaaaaaaagaagaaagaaag

SEQ ID NO: 4022 - DNA, 2728 bp, Homo sapiens
ctagggcagtccgaggagattgaaagggcaaaactatcaagcaagaaaactgtaagttctgattagttttatgactttgccttcatgcctcaggagctcaactgatcacggctttcacgacaggctaaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagca

SEQ ID NO: 4023 - DNA, 6834 bp, Homo sapiens
gggcagggtccccgcgcaccgcggagtgggctgtgattggaggaggagcccgtgccgggcgggcccgagcgggtgtcgagccggttcctccagtctgccccgcgcgcggagctgcgcgcactgggtccccaagagcccgcgggcgtccggcagccgagcgcacgttctttcggatgcacacgcccgggtccctggcgtctgacgccgtggggagggcagcgaggccccagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagcaaaaaataaaataaaatgaaataaaataataaaccactacatacagaaaacaagaactccccttgctggagacagatggttgtaaatatttctccatttttaattgtttagatttctgccttggtgaggcatatcttcattagacttatctaaaggactgcactgaccacagactctgagcatttgaaggttttttgataaaaataaatgctcagtggtttgtgaatagatagcaactctcatatacctgcaaaggcaccaaacctctatgagaaagtagtgccctgtgttgtcagtgagtcaaagatgccctgtacataccttcatggtactgtcattgagaggaatagaacatgatgagctattgaaaaaccctggaacttgttgcatatcaaaacttgggacaaatttaatttacagagatgcttatagcttactatattatagaatccaacagaattatgttgctcttgattaacagaaatattttatttaggaatatataaattcccagaaattccttcctaactgaaaaccctaccacaaaagccagtaaaatttagtttaaggcaatataaaccattgtttatccaataaattatgaagtgttccaaataagaaaaaggtaaataatttgatagttttgagatgcttgtgtaggtatgataaaaaaaaaagttgctgtctgttcattgatttttattatctcttctgatttgtacaggagaatatcttttcttttttatttgacacatggtgttgtatttattttggagctccaatctccactaaattcaggtccatcatactgcctcatagtattaaactcatcagaacatgctgatttttctccagcccgagctacatgaaggaaatgaagcatggaaatggagaactaatagtaaagcaattgagccctgttgcaggtcacatctcaaagaggagcacagctacaaggacatataaattgttcttctgagccattagaatgtcaaaacattggaataaaatatttgtattttagaaagacttcagagagaattgagattttctttgatgcaagaattatttttcaagatcatgagttctacatgctccaaagacgatttcaagaacacaacctttcttgctgcaaacctattgagtaaaatattgagtttttaaaagtcttaatataatgttataaaaattaaaatccatctttaaattctgatgcaaatatgtccctcaagaattaaccaagcaatgtatgatttctgtgtggtttagatgtgccaaaggaaggaaggcaattgcaagtcatcatgtgtttaagtttgagttgagcttgttagagtatgactttcatgaccaaaatgatgtttctacctattatttttcctagattaatactagtttaatgtgcatatacattcaagtaagaatggatttattttttccttcctttctccttttaaaaataattcattgttgggttcctaatacatttacagatagtaaacactgtgtagagaatcatgttctaaaagtgctttttgaaaggtagacagtggaattagaatattaatatgttgattacacaaagaagaactatgtaggattctgtaaacttgcagcccaactttagaaatgaagtatgtaaaagtggccttcaacttcataagtataaataatccaataaatttcattacctgcaaacagttctttaatttgaatagagttttgtagacattgttttatgactatatagatatgcttcttgctgtattaatatgcatatatattttaaaaaattataacagtgaaagatactgttcataacttttaatcacacatgcaagtttttcaaactaaaaaataacaaacaaacaaaaaaacacgcgtatttacccagttcaataaaatcagagtgtggtgcaggaattacagagttgttaagtcagcaaggtgctgagaaaacagtttgtaataatccccttgttgtctgcaagaagatgaaatagtttagtacatttggatgatgtcaaaactgctgattgttgcacataccactaaacggaggtgtggatgtattttagaaaaggaacacacatcattcaccctgctttttctgcttttaaaatgtgtgttttttctcattaattttttcaaatggttaccaatgatagattggaaaaagaaaggttcatgtttaaataataatttaaaattattgcatatacccaattgctatttatgtgtggatgattatatgaatacagtattacatttcattcagtggtattttttaattaaaaaaattaatttaaaaaattaatttttgagatggctggaagaatgttcctaatataggtagtatttatatgaagtattctaagcttaattgtaatagtagtaaattttttgccgttgcttattttagttttcttttttcttctgaaatctaatgctatatatgatgactgtcaatacttgagatataggctttgttttaaaaacagtgattgaagagctgattgataaaattaatattaagtctagttggaaaattctccaaatatgatttaaataaatatatattatcaagttgcttaaattcagtattatactgaaaccaactagaatgagctcacaggaactaattcttcatatctcttcccaactccaggtacagtgatatcattttggtaggttgatgtcagccttggtgggattatttagaccacaacagtaatcagcaaacactacccttttctctggagaacaagttgttaaacatttaccagcactctactgcttaaattattttataaaatgaaatgtcataattgtaaatatagtatgaatttatatgatttaaaataatgacatgaaaggaatttatgctatattttactactaaataacaatgtatgtggtagtgatttcctgaagtgaaatccttggagctacttgtagacagggagaggagtcacttctttatggaaaacaatggctaaatttcaagtagagataatagttcaggaagtcaatatatttaattattttccacttgtccatacaggagcatcaatagaaactcagggtttgccaaattatgcccattttgaacagtttaatttattgaaaaatcagatgcattttacttcttactgtctatgtcaaggaaatacacccaagcccttaatctgaattgtcaccattgcattattaaaaatcaacataaaaatataaaaatcaaatcttaaggaaatggatttctggagatcaagcctaaattatcaatctcaattcacaaattagtctctgaaagaaatattccaagatcagccagctaaggaacaaaatcaggaaagagacatcaataaaaaattaggtagtaatttgcaggcaataagtagatttttgatttttctacaagcaatcaccagatctgggatctggtaaatgtctttatttgccaggaagctctgctgatgactacaattgaggttagttgtctacaagatacatgcaggaggtagtagtggttaagtaatggtagctgccttttcactctgccctctgaggaagttttaaattattttatcttcatgcacaattacatttactacattggatggtagacataggcaattattttcatgtcaacggcatagttacacaatgtaggaatgatatttgtgaagtgatccacatgcccaagaaatgcaaatgcaaatagtgttgttagcatttatattgaaatataaaatctaaagcagcttaaaataagctaagctaaacaaactgcaagaagctaaatgatttaaacatgttaaagttttaaagcactagctgtaaatattaatcttcagattttcaatttaacatgtattcacttacaaactgttctaataataacactaattattttccaagtcaccatttaaagttttatttacagttgacctaatccaattgaagttgatgaaagcttcaacttattttttaactctttctggtccacgatgcctggaggcaagtgaaatatatatgacaaataatagataaaccaatttattttctgttagtgtatgtttattttttaattattaataatgtatattgtgtgtatatatgacggtgtatgaaagttggcaatgaaagctaatacaatcatgttagtcggctggatataataaagaacaagaaaggaataa

SEQ ID NO: 4024 - DNA, 2812 bp, Homo sapiens
gggcagggtccccgcgcaccgcggagtgggctgtgattggaggaggagcccgtgccgggcgggcccgagcgggtgtcgagccggttcctccagtctgccccgcgcgcggagctgcgcgcactgggtccccaagagcccgcgggcgtccggcagccgagcgcacgttctttcggatgcacacgcccgggtccctggcgtctgacgccgtggggagggcagcgaggccccaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattggtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactg

SEQ ID NO: 4025 - DNA, 3765 bp, Homo sapiens
ctgggaggcgccgaagtctcagtggctccctgggccggcctccgacagcgctgacagcaggcgcccgccgcccaccatcgtcgccctcttcccctccctcttcggccccggctccggcgcgctctctcctcctctcctgcgcgccctctcgccctctctctggccgcgcgctcccgctggctccggaccctgcgtctcagctgcccgggcgagccggaggggcccctcgcagtgagcagacgcagcgggcccccggcgcccgaggccggggcagggtccccgcgcaccgcggagtgggctgtgattggaggaggagcccgtgccgggcgggcccgagcgggtgtcgagccggttcctccagtctgccccgcgcgcggagctgcgcgcactgggtccccaagagcccgcgggcgtccggcagccgagcgcacgttctttcggatgcacacgcccgggtccctggcgtctgacgccgtggggagggcagcgaggccccaggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtggggacctcagtggtacaagtgacagcgacggatgctgatgatcctacatatggcaacagtgccagagtggtctacagtattctgcaaggacagccgtacttctcagtggagccaaagacaggagtcatcaagactgcccttccaaacatggatagagaggctaaagaccagtatttgcttgtcattcaggcaaaggatatggttggtcaaaatggaggactgtcaggaactacatcagtcactgtgaccctaactgatgtcaacgataatccacctcgctttcctcgaaggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtactcaattgacagaaacacagacttggagagatacttcaatattgatgccaacagtggggtcatcacaactgccaagtctttggatcgagagacaaatgctattcacaatatcacagtccttgcaatggagagccagaatccatctcaagtaggaagaggctatgtggccatcactatacttgacatcaatgataacgcccctgaatttgccatggactatgagaccaccgtctgtgaaaatgcccagccggggcaggttatccagaaaatcagtgctgtggataaagatgagccatccaatggacaccagttttacttcagcttaacaacggatgcaacaaataaccacaacttttcattgaaagataacaaagacaacacagcctcaatactgaccaggagaaacggcttccggagacaggaacaatcagtttactatctgccaattttcattgtggacagtggatctccctcacttagcagcaccaacaccctcaccatccgcgtgtgtgactgtgatgctgacggcgtagcccagacctgcaatgcagaggcctatgtcctacctgctggcctcagtacaggagccctgatagccatactcgcctgtgtcttgacattattgggtaggtactgtttccagggcttgctctgaaagagctgtcacaataaccacatgtcacgacttgcctattatcttctccatttggtgaacatatgcagatattctactggatggtgtttgttttgttttgtttttctttgagacggggtctcactctgttgcccaggctggagtgcagtagaatgatctgggctcactgcagcctctgcctcccaggttcaagcaattctcccacctcagcctcccgagtagctgggattacaggggtgcaccaccacacccagctaacttttgtatctttagtagagactgagtttcaccatgttgggcaggctggtcttgaactcctgacctcaggtgatccacccaccttggcctcccaaagtgctgggattacaggagtgagccacagctcctggcctggatggtgttttgctcactaagtaatacaattgttggccacactttccagtggtatatttgaagtataactcagacaaaaagttgtatcaatttcattttcaaagcaacagtgaagataaatggcttatgctttaaattaatgctttttaggattaaaaataatctatcttatcccagttctttgctttagagcactctacagaggagatacactagactggagaatacattttctatattgttttgacaatatgcttattttagaaattatggctttatattctactttttaaagaaattatttgattgctttcttaaattatttgcaaatttgaaatgattacaatttcagcaatgcaaatcttatatttttaaagtattaaatactaacacatttaattgtacatttccatgattagtttattactcggttaaattaaatttataactcatatttgcagtaactcagattttgcagcatccttttaaaaattgggagatgtccaatgtggacactgggtaatgggtttattccaaagaaacatttttcttcacattgtaacttgtaacacgaacacaacaagaacagagtaaacattcaatataccgttccatatggtgaatgttcaataaattttaagtgttactgatggaaaattataagctaagacctagttactaatacattataaatgctgtcgtgaaaatggaggttattgtcttaagtaacttaagctaaacaagtaaatctaaaagaaaataaactatattttgcatagaacttt

SEQ ID NO: 4026 - DNA, 9721 bp, Homo sapiens
aacataacgccagccccagagctcaggtgagacctctagagagaaagctcgcaggtacctcatccgcatgctgttattatctgccagcccacttatccaggagctcggtcctcagcgggctgcgcgcaccgcgcggaagggcgcatcttcacctcgtggctctggcggcagagacgcgcggggcttgctcgggagcgaggagcgaaaagttgtgcgcccacttgggtagggggaaagagagcgatcgagccagcgcgggagagcgaagggggaaggcggggagggggcggggaggggggactgcttacatgaatttccaagtggtagacctgcctctgcgctctgcccaatgagatccgtcaggggaggcacccggctcacttttccacatcacttcacagttacatttggcaggcaggcgggctcgcacgccggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctggctaatccttagataaatggtttaaatagaggaaaaaatcataattaaaaggtgctttcttagaaaaaaaaatacggacctgcaaggaatctgctgctgatatgtgtcttctgcaaggatttttatgaatgcaaatggttttttccccttcaccaataaggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatacctttgttgtcattaatttttttttcaatcagtggaagatctattaacagaatcatcaactcaaactaaaattctagaatactcaaccaaatcatcccaagggtcacttttgtttgtaagactctttattatagagaaacagagaagagaaatggcttgccagtgatcacacagcaagataccagcagggacataagaggaacatggaacacctaaaggctagtccagctgtgtcatttgggtccttctggaagcagacgcattgggcagggaaaaccttcagacaagtttgcagacctaaaacttgtaacaatagagggattgggagcaggatttggcaagagagtcttagactgcagtgcggacctggcaaaatctctgccagtctgacagggggttctagagtgaaaacacatccattaaagcagtcaggctgtggtcctctgtcatctcagtcattggtgcggggctgctaagaagagaacggtttttgactcaaaagctgaacgcaccaacttctagaggccaccttcactgtgacagaaactgcatgtttaaatactatactaacaatttataactatccggtggcttaatcaactttttattgagtttctgttgctgagaataagtcatcttttatgcgtattattacggctagtgaacactttttcttgaggtcaaagggatggtccaacatgactttaaaatatactaggacttggcacagtgtctaaaacaagtgcttggtgaatgtaaattattagtagtagttgcagtaataaccaatagtaatattccaactatcttacaccttccaaaccaaggagagattattatgttttatgtatctcttgaacaccagactcatttctagtgtactttgaagtgcccaaagattatagacacacaaatatgtctaacagaataattacagtattttttaaggagtataaaatctgtatcctcaaatattggtaatcaacaggataatcttcgtacagtggtttctgtgagcaggagataatgtctgctctactagttgcccaaatatcgcctaagtattctctttgcctaggaacacagaatgaaagcttgcatctcttgctgactttctttgccaccacagtgtcagcattttgtgtttaaaagcctatttcaggtcttgtaacatagaataaagtgactaataccttgatcctaataagattgacctatacttttagagtgtcatgaattaaactaaaaatctcaggaactatctctctctttctctctttctctctctctctctctctctctctcacacacacacacacacacacacacacacacacacaacaaacaaataaaaaacacacattttgacttgaagttttactttagcaatagacttgccaggactttcccaaccaaaagatatcaataaggttcctaacattttctaagatttaagtatcccatgctcaatttgttaaataacacattttaaaaactttattgaaatgactatatttttaaagctatgtgcattgttgtctgtttcatcaacattgacatagcagaaacaagagtactctctgctaaatagagaagaatgattaagttggagccaagtgagacaaagttatctccctctgcctacctcacaattcaaggttcccacctagggaactgatgcatccctgggtgattggacacaacatgggatcaattcagcctctactctgcctatgatttgatcaaatcatattagcaaagtgtctcttaaacatccatatatgaatattaaagagtattaaggggggcatttcttaacaatatttttatgagtatagttataagtttctaaacatttataatacgatgactaaaatatgctatttttaaattcaagtgttaaccttgccacacagaattatgacttctagggtgtaaactttaaagtgaaactgttttgaaaaaaatctgcagttaagtgtatgtgtatatatagaagaaaaggaaacttagatttactggtatcaccagtgaagcaagaatgcttagaaagatacaaatgtgtctttgggagagtctgcttaatcagatgcttaaagtaagacaagtctctgcatgagacttagaaatctcctaggagcagctggattccacactgagactcaacagagttctgggctatgctgtattttggaaaaggaaaagcgggtgctgagagctaagtagccaattactctttatagccacataaggactgaaggcaagtaggcccttccaacaagttgtattatgcgatcactggctttgcagggaatctcacgaatgtataaccttctgattgcctttttgattgaaagttccatctgagatcagggcagtgtaaccagtaataagatttcaaaaaaatcccatcactggcactgtcggaaaggctgagcatgactgaaatcctatcattgtcagtcaaaaagataaggtaacagcgggcatcactataaaagctctataaatgcacaacttaaacatgaatatcaacattaaaaagaatatatatatccttatacatatatttataaatatattcatatatataaatatgcacatatatacacaattcagttactggggataatttatagttttaatttttcatctcataatctcacgcactgccaacaaattgaaattgtggctctctgttttcatgaatctaaccttgaatttgaaagaagttgaattgagggtaaagggttttaaaagcagctttttatttgtgaacagaataatggctcataatacctgggattagaattaaatatgtcacgttgtgaggctgtacttagactttttaaatgtcattgtatttttttgtggacaaaataattgtagaatatactttgcaggaaatacttttctatattttttcaatttcaatactgttttatttgctataaaaagtgtctttgcactgttactcagccaaacagtgttgaatgtattatttgcccttgtaattattgcttcttatgataattgtagaagagcatgtctttatgatctatcatttaaaaatacatttattgtcattgtagttttagtcaacacaaatttatggattacatggtatactgttgctattgaagatattctagtcctagtattttgagcacagacctagcgttatggaggacataaaatttaaaaatttcctgacttgatggactatctgaggaaaaagaattttgtctgtcacatttattgagtatctatcagtacagaaattaagctacatggttgatacagaaagattaaatacagtagcattctcaaacttattttctttatttataaaatgtacctaatcaatctcataagaactaattgttgaattttttttttatctatggataaatactatttgagtctgggtttaagtttggttgatctgacactaaatccccttaactttcaactaaacagttatctctgtaattatgagacttttgatgataagaaatagaaactaagttatatatagtgctatggaagtactgaggaggaagtaagggaccccatatgggaagactcaagaagacgtcacggtgaaattttccaaaaagatgggaactcaagaatgggtgcaacagaaatcacagcttttccaaatactaaaagggaaaattataaaaagcaccaatggcacacttttggacattcagaaagatccagaaattaggtgcttataggaaactctaggtttgccaaattgtagtgttttatggataggaaaaatgaagttcagaaacgttataaggaattttcagggttaaattacacatcaaatatgtgagagaaacagaaattacatgctggtatttggggtcatctcctgagttgtaatgttgtaagtgtttttgtatgtattctcctccttcctttatgtgtggaagtttcatctaggtctcaaggttagtaggcatttgctggtgaaaatagtgcctttgggtactatttccccaacttgagttacctgccaccatctaattcacatcttgaatgcaagtattatttcttgcaagtatccctactaatagataatagatatttctattattatccacagattacagaagagggttgctaggaggaatatcacaagatgctgtctgaagagaaagactgtggaaaaccatggcttcaatgaactcagaggtcaggaccagaaaaggaaatgagaggtcaccaaagccaaatgttaatttcttgggatttcttctgtacatgcaaagaacttcaggccatcctatgattcctcaaaaataagaggaaaattttaacaattatgctctaagatggaccatgacaatttaggagtcattgggatcaccccccaaagccaaatgttaatttcttgggatttcttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaa

SEQ ID NO: 4027 - DNA, 4950 bp, Homo sapiens
aacataacgccagccccagagctcaggtgagacctctagagagaaagctcgcaggtacctcatccgcatgctgttattatctgccagcccacttatccaggagctcggtcctcagcgggctgcgcgcaccgcgcggaagggcgcatcttcacctcgtggctctggcggcagagacgcgcggggcttgctcgggagcgaggagcgaaaagttgtgcgcccacttgggtagggggaaagagagcgatcgagccagcgcgggagagcgaagggggaaggcggggagggggcggggaggggggactgcttacatgaatttccaagtggtagacctgcctctgcgctctgcccaatgagatccgtcaggggaggcacccggctcacttttccacatcacttcacagttacatttggcaggcaggcgggctcgcacgccggagcgctcagcccagaattagtggatttatttggaatctccctgcctcctccaagctccgccgccgccgccggcttgtgcatagacggtagcgtcaagacaccagctgcactttgggttgcggacacccagagcccagcgcgcccgccctgcgtctccgcaccaagccctgtagctccgagaggcatgaacggaatccggaggcgcctgcctagcgagcgaggaccggtcggcgcttgccgccctcgggagctaaccccgagcacctccagccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctggctaatccttagataaatggtttaaatagaggaaaaaatcataattaaaaggtgctttcttagaaaaaaaaatacggacctgcaaggaatctgctgctgatatgtgtcttctgcaaggatttttatgaatgcaaatggttttttccccttcaccaataaggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaacttttggactgttttctattttgttcataatcctagtatttggtgtttttactacaagcacaaacatcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaat

SEQ ID NO: 4028 - DNA, 3079 bp, Homo sapiens
actgagatgcatgaagattcagctgtgaagatactataaaaagggaagagaaggaccgagacagaagcaacaacggaactgtcagtgcggagtagggctaaactcagttccattgttaagcaaggaaaaacaaacaatacattgaatttgacaacccactgaagttgcagataatgaggacttaccattatataccattattcatctggacctatatgttccatacagttgacaccatcctattacaagaaaaacctaacagttatttatcaagcaaaaagatagcgggtctgacaaaagatgacggtaaaatgctacgtcgcaccaagcgtggctggatgtggaatcagttcttcttattggaagagtacacaggtactgacacacaatatgtaggcaagcttcacactgaccaagataaaggagatggaaatttaaaatacatactaacaggagatggggctggcagtctatttgttatagatgaaaatacaggagacattcatgctgcaaagaaactagacagagaagaaaaatctctgtacattcttcgtgccaaggctatagacagaaaaactgggcggcaggtggaaccggaatcggaatttatcattaaaatacatgatatcaatgacaatgagccaaaatttacaaaagacttatacactgccagtgttcctgaaatgtctggagtcggtacatctgttatacaagtaactgcaacagatgcagatgacgccaactatggaaatagtgccaaagtggtctatagcatattgcaaggacagccatatttttcagtggacccagaatcaggcataataaaaactgcattaccagacatgagcagagaaaatagagagcagtaccaggttgttatacaggccaaagacatgggtggccagatgggaggcctttctggaaccaccacagtgaacatcacgctgacagatgtcaacaacaaccctcctcgatttccccagagtacgtatcaatttaattctcctgagtctgtacctcttggaactcatcttggaaggataaaagccaatgaccctgacgtgggggaaaatgcagaaatggagtatagcattgctgaaggagatggtgcagacatgttcgatgtcatcactgacaaggatacacaggaagggattataactgtcaaacagaatttagattttgaaaatcaaatgctctatactttaagagtggatgcaagtaacactcaccctgatccacgattcttacacctgggacctttcaaagatacagctgtggtcaaaatatctgtggaagatatagatgagcctcctgtgttcactaaagtctcttacttgatagaagtagatgaagatgtaaaggagggcagtatcattggacaggttacagcatacgatccagatgccaggaacaatttaataaagtactctgttgatcggcatactgatatggaccgtatttttggtattcactcagaaaatggttctattttcactttgaaagcccttgaccgggaatcatctccttggcataacatcactgttacagccacagaaataaataacccaaaacaaagtagccacatccctgtcttcatcagaattctagatataaatgaccatgctccggaatttgccatgtattatgaaacatttgtttgtgaaaatgcaaaacctgggcagttgattcagactgtcagtgtcatggataaggatgaccctccccgaggtcacaaattcttttttgaaccagtgccagaatttactctcaatccgaatttcaccattgtagataataaagataatacagcaggaatcatgactcggaaagatggctacagtcgcaacaaaatgagcacctacttattgccgattttaatctttgacaacgattatccaattcaaagcagcactggtacactcactatccgtgtgtgtgcctgcgataatcaaggaaacatgcaatcctgcaccgcagaagccctgatcctttcagccggcctgagcacgggagctctcgttgcgattctactctgtgtcctcatactgcttattttagtcgtgttgtttgctgcattgaagaggcaaagaaaaaaggaacctctgataatttcaaaagacgatgtccgggacaacattgtgacctacaacgatgaaggcggcggggaagaagatacccaagcttttgacattggcacattaaggaatccagaggcaagagaagacagtaaacttagacgggatgtaatgcctgaaactatttttcagataaggaggactgtgcctctgtgggaaaatattgatgtacaagattttatccatcgaagattaaaagaaaacgacgcagacccaagtgcacctccatatgattcgctggcaacgtatgcctatgaagggaatgattccatagcagattcgctcagttctttggaatctctcacagctgattgtaaccaagattatgattacctcagtgactgggggcctcgtttcaaaaaacttgccgatatgtatgggggtgatgatagtgaccgagactaagaggattgtttgacttaatcaatattagtggaagtactgtctatgttattagattgagtggcctgcattctcttcctgggaggaaatctttcaaaaattgaagttacaaacaatacgtagatgttgtcaagtagggatttgcttaatcagtaagtctttgtgaatgaatacgaatgatacagatttttaaaaaagtaataaccagttcaccctctttgcctaacaatctcggaaggaaaatatatcacatcaataatcaataaaaataagtaaaaggctttttgtgccttttcttaggtataataatttataaatgttttcttaactgactttcagtcacctttacaattaaactaaatattgtgcaaccgctttgtaaattaatatgaagaagatatatccctaatgaaataggaatgactattactgccatatttatttagttgaagaatgtctttgtgttaattcattcatatttttataaatgtatatttatatttttgtatttttatgaaataaactagtatttataaaac

SEQ ID NO: 4029 - DNA, 532 bp, Homo sapiens
gagatgcatgaagattcagctgtgaagatactataaaaagggaagagaaggaccgagacagaagcaacaacggaactgtcagtgcggagtagggctaaactcagttccattgttaagcaaggtctcattctgtcgcccaggctggagtgtagtggcaggatcttggctcactgcaacgtctgcctcttgggttcaagtgattattgtgattcaacctcccaagtatctgggactacaggaaaaacaaacaatacattgaatttgacaacccactgaagttgcagataatgaggacttaccattatataccattattcatctggacctatatgttccatacagttgacaccatcctattacaagaaaaacctaacagttatttatcaagcaaaaagatagcgggtctgacaaaagatgacggtaaaatgctacgtcgcaccaagcgtggctggatgtggaatcagttcttcttattggaagagtacacaggtactgacacacaatatgtaggcaagcttcacactgaccaaga

SEQ ID NO: 4030 - DNA, 556 bp, Homo sapiens
agacttaactggggaagcctctattgtccctagcatttaccctattgtgtccggaattggtgggttcttggtctcactgacttcaagaacgaagccgcgcaccctcacggaaaaacaaacaatacattgaatttgacaacccactgaagttgcagataatgaggacttaccattatataccattattcatctggacctatatgttccatacagttgacaccatcctattacaagaaaaacctaacagttatttatcaagcaaaaagatagcgggtctgacaaaagatgacggtaaaatgctacgtcgcaccaagcgtggctggatgtggaatcagttcttcttattggaagagtacacaggtactgacacacaatatgtaggcaagcttcacactgaccaagataaaggagatggaaatttaaaatacatactaacaggagatggggctggcagtctatttgttatagatgaaaatacaggagacattcatgctgcaaagaaactagacagagaagaaaaatctctgtacattcttcgtgccaaggctatagacag

SEQ ID NO: 4031 - DNA, 11389 bp, Homo sapiens
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactggagagcactgtgaggtggatgcccgctcaggccgctgtgccaacggggtgtgcaagaacgggggcacctgcgtgaacctgctcatcggcggcttccactgcgtgtgtcctcctggcgagtatgagaggccctactgtgaggtgaccaccaggagcttcccgccccagtccttcgtcaccttccggggcctgagacagcgcttccacttcaccatctccctcacgtttgccactcaggaaaggaacggcttgcttctctacaacggccgcttcaatgagaagcacgacttcatcgccctggagatcgtggacgagcaggtgcagctcaccttctctgcaggcgagacaacaacgaccgtggcaccgaaggttcccagtggtgtgagtgacgggcggtggcactctgtgcaggtgcagtactacaacaagcccaatattggccacctgggcctgccccatgggccgtccggggaaaagatggccgtggtgacagtggatgattgtgacacaaccatggctgtgcgctttggaaaggacatcgggaactacagctgcgctgcccagggcactcagaccggctccaagaagtccctggatctgaccggccctctactcctggggggtgtccccaacctgccagaagacttcccagtgcacaaccggcagttcgtgggctgcatgcggaacctgtcagtcgacggcaaaaatgtggacatggccggattcatcgccaacaatggcacccgggaaggctgcgctgctcggaggaacttctgcgatgggaggcggtgtcagaatggaggcacctgtgtcaacaggtggaatatgtatctgtgtgagtgtccactccgattcggcgggaagaactgtgagcaagccatgcctcacccccagctcttcagcggtgagagcgtcgtgtcctggagtgacctgaacatcatcatctctgtgccctggtacctggggctcatgttccggacccggaaggaggacagcgttctgatggaggccaccagtggtgggcccaccagctttcgcctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccagaacaaggcagatatcgggggcatgcttcccgggctgacggtaaggagcgtggtggtcggaggcgcctctgaagacaaggtctccgtgcgccgtggattccgaggctgcatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaagggtaccttggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgtacttctgcggtgctggtttttctccacaaacacccccgcccctccccatgcccagggtggccgtggaagggacggtttacggacgtgcagctgagctgtccgtgtcccatgctccctcagccagtggaacgtgccggaactttttgtccattccctagtaggcctgccacagcctagatgggcagtttttgtctttcaccaaatttgaggactttttttttttgccattatttcttcagttttcttttcttgcactgatctttctcctctccttctgtgactccagtgactcagacgttagacctcttgatgttttcccactggtccctgaggctctgttc

SEQ ID NO: 4032 - DNA, 4194 bp, Homo sapiens
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactgctgtttcttag

SEQ ID NO: 4033 - DNA, 2446 bp, Homo sapiens
ctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactgaaatttcgtgactcatcctcccgcctctgaagatgctctttccttgatacctcctgactcatcaccaagatgaattactccaaatgtagccaacggtggtttttaaaaataaagagccaccccgagagcggtacagaaa

SEQ ID NO: 4034 - DNA, 10534 bp, Homo sapiens
aggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtgagaagcgctatgtggtccaggtgagggaggatgtgactccaggggccccagtactccgagtcacagcctcggatcgagacaaggggagcaatgccgtggtgcactatagcatcatgagtggcaatgctcggggacagttttatctggatgcccagactggagctctggatgtggtgagccctcttgactatgagacgaccaaggagtacaccctacgggtgcgagcacaggatggtggccgtcccccactctctaatgtctctggcttggtgacagtacaggtcctggatatcaacgacaatgcccccatcttcgtcagcacccctttccaggctactgtcctggagagtgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactatgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtctttcagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcccggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccggagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggaggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgcctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgtgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctcccccgtcttctcccctcagcaattcctgcaaagggttaaaaatttaactggtttttactactgatgacttgatttaaaaaaaatacaaagatgctggatgctaacttggtactaaccatcagattgtacagtttggttgttgctgtaaatagggtagcgttttgttgttgttgttttttcatgccccatactactgaataaactagttctgtgcgggt

SEQ ID NO: 4035 - DNA, 11956 bp, Homo sapiens
agcgaaccatcggggcggccgggagccatgttggagcggcgggaggcggcagcagcgtcggggatgctgtggtgggggcggaaaaagccagggccgcacgccggaggggctccggccgcggagtagatggtgcccagagggcggcgggggtgcggagagacaggcggaggggcgggggcccggggcggcggcaggggcccgggagggggcccgagcggcggggccagcccaaggcccggaccggggcggggggcggtggaggccgtgcagggaggcgggggatgatggcgaggcggccgccgtggcggggcctcgggggacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgacatccggagcagaaaggacagccccccggcggaactgtcttccaggggcctcgggatctggccccgagctggattcagcaccacgcacggcgaggacagctcctgcatcaggttcagcaccccgcgagtctcggacagctcccgagccggcgcccaagcgcatgcgctcccggggtctcttccgctgccgcttcctcccgcagcgccccgggccgcgtcccccgggactcccggcccgtcctgaagccaggaaagtaacctcggcgaaccgggcacgctttcgtcgcgccgcaaaccgccacccgcagtttccgcagtacaactaccagacgctggtgccggagaatgaggcagcaggcaccgcggtgctacgcgtggttgctcaggacccggacgccggcgaggccgggcgcctagtctactcgctggcggcactcatgaacagccgctcgctggagctgttcagcatcgacccgcagagcggccttatccgtacggcggcagctctggaccgcgagagcatggagcgtcactacctgcgtgtgaccgcgcaggaccacgggtcgccgcgcctctcggccaccacgatggtggccgtgacagtagccgaccgcaacgaccactcgccggtttttgagcaagcgcagtaccgggagacccttcgcgagaatgtggaggagggctaccctatcctgcagctgcgtgccactgacggcgacgcgccccccaacgccaacctgcgctaccgcttcgtggggccgccagctgcgcgcgctgcagctgccgccgccttcgagattgatccacgctccggcctcatcagcaccagcggccgagtggaccgcgagcacatggaaagctatgagctggtggtggaagccagcgaccagggccaggaacccgggccgcgctcggccactgtgcgcgtacacataactgtgctagacgagaacgacaatgctcctcagttcagcgagaagcgctacgtggcgcaggtgcgcgaggatgtgcgcccccacacagtcgtgctgcgcgtcacggccactgaccgggacaaggacgccaacggattggtgcactacaacatcatcagtggcaatagccgtggacactttgccatcgacagcctcactggcgagatccaggtggtggcacctctggacttcgaggcagagagagagtatgccttgcgcatcagggcgcaggatgctggccggccaccgctgtccaacaacacgggcctggccagcatccaggtggtggacatcaatgaccacattcctatttttgtcagcacgcccttccaagtttctgtcttggaaaatgctcccttgggtcactcagtcatccacattcaggcagtcgatgcagaccatggggagaatgccagattggagtactccctaactggtgtggcacctgatactccttttgtgataaacagcgccactggctgggtctctgtgagtggtcccctggaccgtgagtctgtggagcattacttctttggtgtggaggctcgagaccatggctcacccccactctctgcctcagccagtgtcaccgtgactgtgctggacgttaatgacaatcggcctgagttcacaatgaaggagtaccacctacgactgaatgaggatgcagctgtgggcaccagtgtggtcagcgtgaccgcagtagaccgtgatgccaacagtgccatcagctaccagatcacaggcggcaacacccggaatcgctttgccatcagcacccaggggggtgtgggtctggtgactctggctctgccactggactacaagcaggaacgctacttcaagctggtactaactgcatctgaccgtgcccttcatgatcactgctatgtgcacatcaacatcacagatgccaacactcatcggccggtctttcaaagtgcccactactcagtgagtgtgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtggggagctgcgactcagccgaaagctagacaataaccgcccactggtggcctccatgttggtgactgtcacagatggcctgcacagcgtgacggcgcagtgtgtgctgcgcgtggtcatcatcacggaggagttgctggccaacagcctgaccgtgcgccttgagaacatgtggcaggagcgcttcctgtcaccgctgctgggccgcttcctcgagggcgtggctgcggtgctcgctacgcccgctgaggacgtcttcatcttcaacatccagaacgacacagacgtagggggcaccgtgctcaatgtgagtttctcggcgctagctccacgtggggccggggcgggcgctgcagggccctggttcagctccgaggagctgcaggagcagttgtacgtgcgccgggcggcgctggcggctcgctccctgctcgacgtactgcccttcgacgacaacgtgtgcctgcgagagccctgtgagaactacatgaaatgcgtgtccgtgctccgctttgactcgtccgcgcccttcctggcctcggcctccacgctgttccgacccatccagcccatcgctggcctgcgctgccgctgcccgcccggattcacgggagacttttgcgagaccgagctcgacctctgctactccaacccatgtcgcaacggcggagcctgcgcgcggcgcgagggaggctacacgtgcgtctgccgcccgcgcttcaccggagaggactgcgagctggacaccgaggccggccgctgcgtgccgggcgtctgccgcaacgggggcacctgcaccgacgcgcccaacggcggctttcgctgccagtgcccggcaggcggcgccttcgagggcccgcgctgcgaggtggctgcgcgctccttcccgcccagttcgttcgtcatgtttcgcggcctgcggcagcgattccaccttacgctgtccctctcgttcgcgacagtgcagcagagcgggctgctcttctacaacgggcgcctgaacgagaagcacgacttcctggccctggaactcgtggctggccaagtgcggctcacatattccacgggtgaatccaacaccgtggtcagccccacagttccagggggcttgagtgacgggcaatggcatacagtgcatctgagatactacaacaagccccggacagatgccctagggggtgcacagggcccctccaaggacaaggtggctgtgctaagcgtggatgattgtgatgtggccgtggctctgcagtttggtgctgagattggcaactactcatgcgcggctgctggtgtgcaaacaagctccaagaagtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggctgccaagccaagctacacttttgtgactcaggcccctgcaagaacagtggcttctgctcggagcgctggggcagcttcagctgcgactgccctgtgggcttcggcggcaaagactgtcagcttactatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccagctagatcgggggttactgtctgtgacagtgaccaggggctcgggccgtgcttcccatctccttctggaccaggtgactgtcagtgatggccggtggcacgatctgcggctggagttgcaggaggaaccaggtggccggcggggccaccatgtccttatggtctcactggactttagcctcttccaggacaccatggcggtggggagtgagctgcagggcctgaaggtaaagcagctccacgtgggaggcctgccccccggcagtgcagaggaggctcctcagggtctggttggctgcatccagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggttactacggcccaggctgtgtggatgcctgcctcctgaacccctgtcagaaccagggatcatgccggcacctgccaggagccccccatggctatacctgtgactgtgtgggtggctatttcgggcaccactgtgagcacaggatggaccagcagtgcccacggggctggtgggggagcccaacctgtggcccctgcaactgtgatgttcacaaaggttttgatcccaactgcaacaagacaaatgggcagtgtcactgcaaggagttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacagtcccttcgcagaggtgacagccagcggctgccgggtgctctatgatgcctgccctaagtccctgagatctggtgtgtggtggccccagacaaagtttggcgtcctggccacagtgccctgtccccggggggccctgggtgctgctgtgcggctgtgtgatgaggcccagggttggctggagcccgacctcttcaactgtacctcccctgcctttcgagagctcagtctgctgctggatggcctagagctgaacaagacggcactggataccatggaggccaagaagctggctcagcggctacgggaggtgactggccacactgaccactattttagccaagatgttcgagtcactgcccgcctgctggcccacctgctggccttcgagagccatcagcagggcttcgggctgacagccacacaggatgcccacttcaatgagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcatgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaagttctgcccacaagcagcagcatagaaaactccaccacctcaagtgtggtccccccaccagccccgccagagccagagcctgggatctccattatcattctcctcgtttaccgcaccttagggggactgctccctgcccagttccaggcagaacgccgaggtgccaggcttcctcagaaccccgtcatgaactccccggtggtcagcgtggctgtgttccacggacgcaacttcctaaggggaatcctggagtcccccatcagcctagagtttcgcctgctacagacagcgaatcggagcaaggcgatctgtgtgcagtgggacccacctggcctggcggagcagcatggtgtgtggacagcacgggactgcgagctggtgcacaggaatgggtcccacgcacggtgtcgctgcagccggacagggacctttggggtcctcatggatgcctctccccgtgagaggctggagggcgacctggagctgctggctgtgttcacccacgtggtcgtggctgtgtctgtggctgcgctggtgctgactgcagccatcctgctgagcctgcgcagcctcaagtccaatgtgcgtgggatccatgccaatgtggcagccgccctgggggtggcagagctcctcttcctgctggggattcacaggacccacaatcagctggtgtgcactgcagtcgccatcctcctgcactacttcttcctcagcaccttcgcgtggctcttcgtgcaggggctgcacctctaccgcatgcaggttgagccacgcaacgtggaccgcggcgccatgcgcttctaccatgccctgggctggggcgtccctgctgtgctgctgggccttgctgtgggcctggaccctgagggctatgggaaccctgacttctgctggatctcagtccacgagcccctcatctggagctttgctggccctgttgtcctggtcatagtgatgaacgggaccatgtttctcctcgctgcccgcacatcctgctccacagggcagagggaggccaagaagacctctgcactgacccttcgcagctccttcctgctgcttctgctggtcagtgcctcctggctctttgggctcctggcagtcaaccacagcatcctagccttccactacctccatgctggactctgcggcctccagggcctggcggtgctgctgctcttctgtgtcctaaatgcagatgctcgggctgcctggatgccagcctgtctgggcaggaaggcagcgcctgaggaggcaaggccagcacctgggctgggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcagggacaatgtcctggttcgacatggctcagccgctgaccacactgaccacagcctccaggctcatgctggccccactgacctggacgtggccatgttccatcgagatgctggcgcagactccgactctgacagtgacctgtccttggaggaggagaggagtctctccattccatcttcagaaagcgaggacaatggccggacgcgggggcgcttccaacggccactctgccgagcagcccagagtgagaggctcctcacccaccccaaagatgtggatggcaatgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgctgtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaagttcccagaagtgagggtcactcctgaggggatgacggcgtggacgaggaacagctgagggcgacagaggatctaggctaacaggagagactccaggagtgggggcagatcccaaggcagcctcctgctccccagtggtgggtgccccagctctacctggtgtggcagggctgaggctccatgtgcatctgtgagcatgcgtgtgacaggtgcagagacgggggactggagggagacttttatacgttttgtacctttgtaaccagagagatgcttatgttatttttcagcttttctgtctcctggggggtttgaggctgggctgggagggggagggagatagagggagagatgcagtttgaccccatttgggtcctgagcaaaccctatgctcatctctctctccttcctggggtggactcagatgggtgggacacatgccttcctccccctattccacccccaagttgatctgagtatcgtcaggggcccaaagtacagaattgttctttgctttttattgaatgctccaaaggccaaacttctggggctgggggttggtcttggaaacaggggtcctctgacttcctcatgggggcttgctcataccgcccctcctggtggatgtgtgtgtttattatgtggagtccctgccacttactgccttatgacctaggactgatgctgtggggtgctggtggagcagctgatgtcgtgtttacagagcaaggcttccctgtctcccacggggaggggctcgggcctctagtcagacattcctgcagagggtcggtggaggggtcattcacctgcccctgcagcaagcaaaagttgtctgtggtgccatttgattccctgacactgccccctgcttgaattgattccgaagggtagggtgggaaggtgagcaaagggagcagaaacaagggaattcaagacccagaatgtaggtgccactgcctcctatgtttacaggatcctccgtggccctaggcacctgggctgcaggaagtgactccgttccactcctcctttattcccttaaaaagggaaaaatgactgttacgaccctgttcacaaaactcttacttttgctattttgtctgctgtccagaactgaagactttaaaattttgttactgtttacaagtccagattcaaaaaatgtttttactttgtttacaactcaaaactttgagttttacactttgtttacagtagataattttttttcctttgtttccaagtgaaaggtagggaaagtgggagagggacttggaggacccacctgtgaggaccctgacctggccatcttgaggggttttctaacccccaggtctcccaggccgaaggtcagccttgagtcccgtttaacagcagatccagaagaccttgagagtaggcgtcctctaaccacgggggagagtggctgtgcagggctggggggtggtctgtgcagacacctcctcacccaccaccccatgcatactcttgggaagcagcttcctgggagattagaaattctacttccctgactggagctaaatcccaccagccaggacccaaactctccttaccgagaaggaccccagctcttgaagggctgagtggcctgctgggggtgggagggtgtctttactatgtcctaggtttcgtagatgcccctctctggggttcccctcctccagcccagcggccctctttcctgtctgtgtaaattgttccgtgaagccgcgctctgttttgggaataaacttctatag

SEQ ID NO: 4036 - DNA, 11971 bp, Homo sapiens
agcgaaccatcggggcggccgggagccatgttggagcggcgggaggcggcagcagcgtcggggatgctgtggtgggggcggaaaaagccagggccgcacgccggaggggctccggccgcggagtagatggtgcccagagggcggcgggggtgcggagagacaggcggaggggcgggggcccggggcggcggcaggggcccgggagggggcccgagcggcggggccagcccaaggcccggaccggggcggggggcggtggaggccgtgcagggaggcgggggatgatggcgaggcggccgccgtggcggggcctcgggggacggtcgacccccatactcctgctccttctcctctctttgttccccctcagccaggaggagctggggggcggtgggcaccagggctgggacccaggcttagctgccactacggggccaagggcgcatatcggtggcggagccttagctctttgtccggagtcttccggggtccgggaggatggggggcctggcctgggggtcagggagcctatcttcgtggggctccgagggagaaggcaaagcgcccggaatagtcgagggccccctgagcagccgaatgaggagctggggattgaacacggcgtccagccattgggcagccgcgaacgagagacaggacagggaccagggtctgtgttatactggcgcccagaggtctcctcttgcgggcggacaggacctttgcaaagaggtagtctgtcaccaggggctctgtcctcaggggtcccgggctcggggaacagctcgcccctcccttcagactttttgattcggcaccacggtcccaagccggtgtcctcccagcggaacgctgggacaggctcccgcaaaagagtgggcaccgcgcgctgctgtggggaattatgggcaacagggagcaagggtcagggcgagagagccacgacatccggagcagaaaggacagccccccggcggaactgtcttccaggggcctcgggatctggccccgagctggattcagcaccacgcacggcgaggacagctcctgcatcaggttcagcaccccgcgagtctcggacagctcccgagccggcgcccaagcgcatgcgctcccggggtctcttccgctgccgcttcctcccgcagcgccccgggccgcgtcccccgggactcccggcccgtcctgaagccaggaaagtaacctcggcgaaccgggcacgctttcgtcgcgccgcaaaccgccacccgcagtttccgcagtacaactaccagacgctggtgccggagaatgaggcagcaggcaccgcggtgctacgcgtggttgctcaggacccggacgccggcgaggccgggcgcctagtctactcgctggcggcactcatgaacagccgctcgctggagctgttcagcatcgacccgcagagcggccttatccgtacggcggcagctctggaccgcgagagcatggagcgtcactacctgcgtgtgaccgcgcaggaccacgggtcgccgcgcctctcggccaccacgatggtggccgtgacagtagccgaccgcaacgaccactcgccggtttttgagcaagcgcagtaccgggagacccttcgcgagaatgtggaggagggctaccctatcctgcagctgcgtgccactgacggcgacgcgccccccaacgccaacctgcgctaccgcttcgtggggccgccagctgcgcgcgctgcagctgccgccgccttcgagattgatccacgctccggcctcatcagcaccagcggccgagtggaccgcgagcacatggaaagctatgagctggtggtggaagccagcgaccagggccaggaacccgggccgcgctcggccactgtgcgcgtacacataactgtgctagacgagaacgacaatgctcctcagttcagcgagaagcgctacgtggcgcaggtgcgcgaggatgtgcgcccccacacagtcgtgctgcgcgtcacggccactgaccgggacaaggacgccaacggattggtgcactacaacatcatcagtggcaatagccgtggacactttgccatcgacagcctcactggcgagatccaggtggtggcacctctggacttcgaggcagagagagagtatgccttgcgcatcagggcgcaggatgctggccggccaccgctgtccaacaacacgggcctggccagcatccaggtggtggacatcaatgaccacattcctatttttgtcagcacgcccttccaagtttctgtcttggaaaatgctcccttgggtcactcagtcatccacattcaggcagtcgatgcagaccatggggagaatgccagattggagtactccctaactggtgtggcacctgatactccttttgtgataaacagcgccactggctgggtctctgtgagtggtcccctggaccgtgagtctgtggagcattacttctttggtgtggaggctcgagaccatggctcacccccactctctgcctcagccagtgtcaccgtgactgtgctggacgttaatgacaatcggcctgagttcacaatgaaggagtaccacctacgactgaatgaggatgcagctgtgggcaccagtgtggtcagcgtgaccgcagtagaccgtgatgccaacagtgccatcagctaccagatcacaggcggcaacacccggaatcgctttgccatcagcacccaggggggtgtgggtctggtgactctggctctgccactggactacaagcaggaacgctacttcaagctggtactaactgcatctgaccgtgcccttcatgatcactgctatgtgcacatcaacatcacagatgccaacactcatcggccggtctttcaaagtgcccactactcagtgagtgtgaatgaagatcggccaatgggtagcaccatagtggtcatcagtgcctctgatgatgacgtgggtgagaatgctcgtatcacctatctcctggaggacaacctgccccagttccgcattgatgcagactcaggagccattacattacaggccccattagactatgaggaccaggtgacctacaccctggctatcacagctcgggacaatggcatcccacagaaggcagacactacttatgtggaggtgatggtcaatgacgtgaatgacaatgctccacaatttgtggcctcccactatacagggctggtctctgaggatgccccacctttcaccagtgtcctgcagatctcagccactgaccgggatgctcatgccaatggccgggtccagtacactttccagaatggtgaagatggggatggagattttaccattgagcccacctctggaattgtccgtacagtaaggcggctagaccgggaggcagtatcagtgtatgagttgactgcctacgcagtggacagaggtgtgcccccactccggactccagtcagtatccaggtgatggtgcaggatgtgaacgacaatgcacctgtcttcccagctgaggagtttgaggtgcgggtgaaagagaatagcattgtgggctcagtggtggcccagatcactgcagtggaccctgacgaaggccccaatgcccatataatgtaccagatcgtggaggggaacatccctgagctgttccaaatggacatcttctctggagaactgacggcactcattgacctagactatgaggctcgccaagaatatgtgattgtggtgcaggccacatctgctcctttggtcagccgggccactgtgcacgtccgcctggttgaccagaatgacaacagccctgtgctcaacaacttccagatcctcttcaacaactatgtatccaaccgttcagacaccttcccgtcgggcattattgggcgcatcccagcttatgaccccgatgtctccgaccacctcttctactcctttgagcgtggcaatgagctgcagctgctggtagtcaaccagaccagtggggagctgcgactcagccgaaagctagacaataaccgcccactggtggcctccatgttggtgactgtcacagatggcctgcacagcgtgacggcgcagtgtgtgctgcgcgtggtcatcatcacggaggagttgctggccaacagcctgaccgtgcgccttgagaacatgtggcaggagcgcttcctgtcaccgctgctgggccgcttcctcgagggcgtggctgcggtgctcgctacgcccgctgaggacgtcttcatcttcaacatccagaacgacacagacgtagggggcaccgtgctcaatgtgagtttctcggcgctagctccacgtggggccggggcgggcgctgcagggccctggttcagctccgaggagctgcaggagcagttgtacgtgcgccgggcggcgctggcggctcgctccctgctcgacgtactgcccttcgacgacaacgtgtgcctgcgagagccctgtgagaactacatgaaatgcgtgtccgtgctccgctttgactcgtccgcgcccttcctggcctcggcctccacgctgttccgacccatccagcccatcgctggcctgcgctgccgctgcccgcccggattcacgggagacttttgcgagaccgagctcgacctctgctactccaacccatgtcgcaacggcggagcctgcgcgcggcgcgagggaggctacacgtgcgtctgccgcccgcgcttcaccggagaggactgcgagctggacaccgaggccggccgctgcgtgccgggcgtctgccgcaacgggggcacctgcaccgacgcgcccaacggcggctttcgctgccagtgcccggcaggcggcgccttcgagggcccgcgctgcgaggtggctgcgcgctccttcccgcccagttcgttcgtcatgtttcgcggcctgcggcagcgattccaccttacgctgtccctctcgttcgcgacagtgcagcagagcgggctgctcttctacaacgggcgcctgaacgagaagcacgacttcctggccctggaactcgtggctggccaagtgcggctcacatattccacgggtgaatccaacaccgtggtcagccccacagttccagggggcttgagtgacgggcaatggcatacagtgcatctgagatactacaacaagccccggacagatgccctagggggtgcacagggcccctccaaggacaaggtggctgtgctaagcgtggatgattgtgatgtggccgtggctctgcagtttggtgctgagattggcaactactcatgcgcggctgctggtgtgcaaacaagctccaagaagtccctggacctgacgggccctcttcttctgggaggtgtccccaacctccccgagaacttccccgtatcccataaggacttcatcggctgtatgcgggacctgcacattgatggccgccgagtggacatggcggcttttgtcgcaaataatggcaccatggcaggctgccaagccaagctacacttttgtgactcaggcccctgcaagaacagtggcttctgctcggagcgctggggcagcttcagctgcgactgccctgtgggcttcggcggcaaagactgtcagcttactatggcccatccccaccatttccgtggcaacggcacactgagctggaactttggaagtgacatggctgtgtctgtgccatggtacctggggctggcatttcggacacgggcaacgcagggggtcctgatgcaagtgcaggctgggccacacagcacgctcctttgccagctagatcgggggttactgtctgtgacagtgaccaggggctcgggccgtgcttcccatctccttctggaccaggtgactgtcagtgatggccggtggcacgatctgcggctggagttgcaggaggaaccaggtggccggcggggccaccatgtccttatggtctcactggactttagcctcttccaggacaccatggcggtggggagtgagctgcagggcctgaaggtaaagcagctccacgtgggaggcctgccccccggcagtgcagaggaggctcctcagggtctggttggctgcatccagggggtgtggctcggctccacaccctctggctccccggccctgctaccccccagccaccgagtgaatgcggagcctggctgtgttgtgaccaacgcctgtgcctctgggccctgcccacctcacgcagactgccgggacctctggcagaccttttcttgcacctgccagccaggttactacggcccaggctgtgtggatgcctgcctcctgaacccctgtcagaaccagggatcatgccggcacctgccaggagccccccatggctatacctgtgactgtgtgggtggctatttcgggcaccactgtgagcacaggatggaccagcagtgcccacggggctggtgggggagcccaacctgtggcccctgcaactgtgatgttcacaaaggttttgatcccaactgcaacaagacaaatgggcagtgtcactgcaaggagttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacagtcccttcgcagaggtgacagccagcggctgccgggtgctctatgatgcctgccctaagtccctgagatctggtgtgtggtggccccagacaaagtttggcgtcctggccacagtgccctgtccccggggggccctgggattgcggggtgcaggtgctgctgtgcggctgtgtgatgaggcccagggttggctggagcccgacctcttcaactgtacctcccctgcctttcgagagctcagtctgctgctggatggcctagagctgaacaagacggcactggataccatggaggccaagaagctggctcagcggctacgggaggtgactggccacactgaccactattttagccaagatgttcgagtcactgcccgcctgctggcccacctgctggccttcgagagccatcagcagggcttcgggctgacagccacacaggatgcccacttcaatgagaatctgctgtgggccggctctgcactgcttgccccagagacaggggacttgtgggcggcgctggggcagcgggcccctgggggctccccaggcagcgcgggactggtgaggcacctggaggagtatgcagccacactcgcaaggaatatggaactcacatacctgaatcccatggggctggtgacgcctaatatcatgctcagcattgaccgcatggagcaccccagttctccccggggggcccgtcgctaccctcgctaccatagcaacctctttcgaggccaggatgcctgggatcctcacacccatgtgctgctgccttcccagtccccacggccatccccatctgaagttctgcccacaagcagcagcatagaaaactccaccacctcaagtgtggtccccccaccagccccgccagagccagagcctgggatctccattatcattctcctcgtttaccgcaccttagggggactgctccctgcccagttccaggcagaacgccgaggtgccaggcttcctcagaaccccgtcatgaactccccggtggtcagcgtggctgtgttccacggacgcaacttcctaaggggaatcctggagtcccccatcagcctagagtttcgcctgctacagacagcgaatcggagcaaggcgatctgtgtgcagtgggacccacctggcctggcggagcagcatggtgtgtggacagcacgggactgcgagctggtgcacaggaatgggtcccacgcacggtgtcgctgcagccggacagggacctttggggtcctcatggatgcctctccccgtgagaggctggagggcgacctggagctgctggctgtgttcacccacgtggtcgtggctgtgtctgtggctgcgctggtgctgactgcagccatcctgctgagcctgcgcagcctcaagtccaatgtgcgtgggatccatgccaatgtggcagccgccctgggggtggcagagctcctcttcctgctggggattcacaggacccacaatcagctggtgtgcactgcagtcgccatcctcctgcactacttcttcctcagcaccttcgcgtggctcttcgtgcaggggctgcacctctaccgcatgcaggttgagccacgcaacgtggaccgcggcgccatgcgcttctaccatgccctgggctggggcgtccctgctgtgctgctgggccttgctgtgggcctggaccctgagggctatgggaaccctgacttctgctggatctcagtccacgagcccctcatctggagctttgctggccctgttgtcctggtcatagtgatgaacgggaccatgtttctcctcgctgcccgcacatcctgctccacagggcagagggaggccaagaagacctctgcactgacccttcgcagctccttcctgctgcttctgctggtcagtgcctcctggctctttgggctcctggcagtcaaccacagcatcctagccttccactacctccatgctggactctgcggcctccagggcctggcggtgctgctgctcttctgtgtcctaaatgcagatgctcgggctgcctggatgccagcctgtctgggcaggaaggcagcgcctgaggaggcaaggccagcacctgggctgggacctggggcctacaacaacacggctctctttgaggagagtggcctcatccgcatcactctgggcgcctccaccgtctcctctgtgagcagtgcccgctccggccggacccaggaccaggacagccagcggggccgcagctacctcagggacaatgtcctggttcgacatggctcagccgctgaccacactgaccacagcctccaggctcatgctggccccactgacctggacgtggccatgttccatcgagatgctggcgcagactccgactctgacagtgacctgtccttggaggaggagaggagtctctccattccatcttcagaaagcgaggacaatggccggacgcgggggcgcttccaacggccactctgccgagcagcccagagtgagaggctcctcacccaccccaaagatgtggatggcaatgacctcctgtcctactggccagccctgggggagtgcgaggcagccccctgtgctctgcagacttggggctctgaaaggcgcctggggctggacaccagcaaggatgcagctaacaacaaccagccagacccggccctgaccagtggggatgagacttctctgggccgggcccagcgccagaggaaaggcatcctgaagaaccggttgcaatacccactggtgccacagacccgaggtgcccctgagctgtcctggtgccgtgcagccaccttgggccaccgtgctgtgccagctgcctcttacggtcgcatctatgctggcgggggcacgggcagcctttcacagccagccagccgctactcttctagagaacagctggacctgctcctccggcggcaactgagccgtgagcgactagaggaagcccctgcccctgttctacgtcccctgagccggccagggtcccaggaatgcatggatgctgcaccaggccgactggagcccaaagatcggggcagcaccctgccacggaggcagccacctcgggactaccctggcgccatggctggccgcttcgggtcacgggatgcgctcgacttaggggcacctcgagagtggttgagcacgctgcctccgccccgccgcacccgggaccttgacccacagcccccacctctgcccctgtctccccagcggcaactctcaagggaccccctcttgccatcccggccgctggactctctgtctaggagctcgaactctcgggagcagctggaccaggtgcctagccggcacccctcacgagaagcccttgggccactcccgcagctgctcagagctagggaggactcggtcagtggccccagccatggcccctccacagaacagttggacattctttcctccatccttgcctctttcaactcctcggccctctcctctgtgcaatcttcaagcacacccttgggccctcacaccactgccacaccttctgccacagcctctgtgcttgggccctccacgccacgttctgccacgtctcacagcatctcggagctgtcgccagactcagaagttcccagaagtgagggtcactcctgaggggatgacggcgtggacgaggaacagctgagggcgacagaggatctaggctaacaggagagactccaggagtgggggcagatcccaaggcagcctcctgctccccagtggtgggtgccccagctctacctggtgtggcagggctgaggctccatgtgcatctgtgagcatgcgtgtgacaggtgcagagacgggggactggagggagacttttatacgttttgtacctttgtaaccagagagatgcttatgttatttttcagcttttctgtctcctggggggtttgaggctgggctgggagggggagggagatagagggagagatgcagtttgaccccatttgggtcctgagcaaaccctatgctcatctctctctccttcctggggtggactcagatgggtgggacacatgccttcctccccctattccacccccaagttgatctgagtatcgtcaggggcccaaagtacagaattgttctttgctttttattgaatgctccaaaggccaaacttctggggctgggggttggtcttggaaacaggggtcctctgacttcctcatgggggcttgctcataccgcccctcctggtggatgtgtgtgtttattatgtggagtccctgccacttactgccttatgacctaggactgatgctgtggggtgctggtggagcagctgatgtcgtgtttacagagcaaggcttccctgtctcccacggggaggggctcgggcctctagtcagacattcctgcagagggtcggtggaggggtcattcacctgcccctgcagcaagcaaaagttgtctgtggtgccatttgattccctgacactgccccctgcttgaattgattccgaagggtagggtgggaaggtgagcaaagggagcagaaacaagggaattcaagacccagaatgtaggtgccactgcctcctatgtttacaggatcctccgtggccctaggcacctgggctgcaggaagtgactccgttccactcctcctttattcccttaaaaagggaaaaatgactgttacgaccctgttcacaaaactcttacttttgctattttgtctgctgtccagaactgaagactttaaaattttgttactgtttacaagtccagattcaaaaaatgtttttactttgtttacaactcaaaactttgagttttacactttgtttacagtagataattttttttcctttgtttccaagtgaaaggtagggaaagtgggagagggacttggaggacccacctgtgaggaccctgacctggccatcttgaggggttttctaacccccaggtctcccaggccgaaggtcagccttgagtcccgtttaacagcagatccagaagaccttgagagtaggcgtcctctaaccacgggggagagtggctgtgcagggctggggggtggtctgtgcagacacctcctcacccaccaccccatgcatactcttgggaagcagcttcctgggagattagaaattctacttccctgactggagctaaatcccaccagccaggacccaaactctccttaccgagaaggaccccagctcttgaagggctgagtggcctgctgggggtgggagggtgtctttactatgtcctaggtttcgtagatgcccctctctggggttcccctcctccagcccagcggccctctttcctgtctgtgtaaattgttccgtgaagccgcgctctgttttgggaataaacttctatag

SEQ ID NO: 4037 - DNA, 11079 bp, Homo sapiens
gcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgaggtaggagccactgggaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgaaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttg

SEQ ID NO: 4038 - DNA, 3963 bp, Homo sapiens
gcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgaggtaggagccactgggaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtgctgccccggcctccgcccacctgtgcaggcctcctggggccctgcctccacccctcccagatggacagccagactaggtgggggcaggtgagggtggaaaagaggtcagggctctactgttgggctttagcctctggtggtgcctcccgaggatttgctcctggctcttcccaagggctttgcagctggatcactctggactggctccctggggacctcctgaacctgttggttgcagggacggggagcatctaccaaggttcattctagagggaggtaaggccccatgattcctagggaggagccctgagccccactccccgccccaagtctgggtgacagagcagtgacttggaggaatgtggcctcatccttccttggggacctgttgagaattcccacctgtttagaggcagatggttttgatctccctaaatgaaatggttttagctcaaaaa

SEQ ID NO: 4039 - DNA, 4329 bp, Homo sapiens
ccctgctgcaccctgaactaactgatgttaaccctcttctctcttcctcatggctggcaggcccacaggtttgagctctgtttctctgtcacttcccacctcatctcttctctgcctcaccccattgccttcctccatgcccaccacacccccaccacccttcctgtcctgtggggcctgggccaaggccgtggcccagcctttgcagactgaatgcagccgccctctccccatcctcgctccccagcctgggggacagggagcgagagtaggaagaggaggaggaggaggaggaggaggcggcccagggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 4040 - DNA, 1649 bp, Homo sapiens
acaggaagtgtgcccctctctcaggcagctgctaacacctgtcttccttcaactcccacagacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggtgagcgatgggggtggccacagggaggagcgggtgggccagggcagctccgcctccgagtgaggggaacaagatgggtgagaatggaattccacacagcaggcgaatccttgac

SEQ ID NO: 4041 - DNA, 2684 bp, Homo sapiens
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactcttcaggaaggggctcccttgacctaggttgcaatatggaaaaggagccaacctgaggggtgacgagactgagctgaggacactggttttctgcctttccccgagagagactcagtgagggtgggctgggagccctggaagccccctcaaatgggtgggaaggtgccagccatccttgagaagggcaaccctctccatgtgagcacaggcaccagagaggggcaggcgcctggagggtaccggggcacccccagctgcccatggctggacttgccctttgacaaggggccctcccagtgtcatttgtatctgtcagtactcttggttgcaagggacagaaacccttaagtagttcaagcaaaaaaggattggctcatgtaactcaaaagtataagtgatttcaggccgggctcggtggctcacgcctgtcatccaacaccttgagaaagccgaggtgggcggatcacttgaggtcgggagtttgagaccagcctggccaacatggcaaaaccccgtctctactaaaaatacaaaaattagccgggtgtggtggcacacgcctgtagtcccagctactagggaggctgaggcaggagaatcgcttgaacccaggaggcggaggttgcagtgagccgagattgtgtcactgccctccagcctgggcgacagagccagattctgtctc

SEQ ID NO: 4042 - DNA, 4029 bp, Homo sapiens
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagacccagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggaggaagacttggcctccccctgcatatctcccgccccacccagaagggcctttcagagtagcggggagaaagagacgtcacaatttcccggaaaggagttgagaagagagccagggcccagcaaggcccagaacagagctgctttcacagagcccttggccgaggctcccctcttgggaagtaaacaggcacaagaagaaagggctcctttgcccagggagcaggcgcaacagctccaaggctcagagggagagaagggaggaccctga

SEQ ID NO: 4043 - DNA, 1983 bp, Homo sapiens
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagacatggggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaa

SEQ ID NO: 4044 - DNA, 11017 bp, Homo sapiens
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagacccagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgcaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 4045 - DNA, 11137 bp, Homo sapiens
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgaggtaggagccactgggaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagttgcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgcaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 4046 - DNA, 1759 bp, Homo sapiens
cgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccttggccatcatcatcaccaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactctt

SEQ ID NO: 4047 - DNA, 5747 bp, Homo sapiens
gcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggaagacttggcctccccctgcatatctcccgccccacccagaagggcctttcagagtagcggggagaaagagacgtcacaatttcccggaaaggagttgagaagagagccagggcccagcaaggcccagaacagagctgctttcacagagcccttggccgaggctcccctcttgggaagtaaacaggcacaagaagaaagggctcctttgcccagggagcaggcgcaacagctccaaggctcagagggagagaagggaggaccctgaaaacaatttgggtgtgcacccacacctctgcccagaggcctcagttgctgggtggggagggaggcccggagtgaatgagtctctttaccaactatggggtttccgactcggaggctgagccaaacagggaatctgggcctgcccactggggcaggctcccgggcttgggagggacagaagcgtgggaggctggcaatgctcccctccctgcatcgggaccaggaggcgggcaggaaagggctggggagcagggagctgactcccagaaacacagagagcccagaaagccctgaggatttgcgagagtgtggtggctagctccagaaggaggaagtagagggttctctcgatcagggcctcagcttgtgaggacttggagcatacccccctggcctggtgcctgaaacccaattgagagccctccccctcctggacttttccttcttcaggcctcagggcagcctcaacccccaccccaacctccaggaagacagtgcctagtggccagcagggcctgctggtgaggtggatggctacaggctgaatccagcctaggatttgcagggaggccccaggggaagcaaaccaggaagaggttactgagcaggaagggaggaaggaacaaaacccttagggaggaggcctgccccactttctaaacccaaagacttggtttctatttacacaatactactcttactgaaatcctagagccagcgagttaatatagggcagccctgagttctcccatttctcagggagaaatgcagcgtctcaggatgacttctccaaggtcctcttggtaagtttcttgtgaagccggactcactttttgagatcagattgacttggaaggaagggacagtgggcttctccaatagagcctgcttggagagaaatctttctagagtcatctgagggaagatgaggctctgtgttatgccagcttccaccaagactcctgcctcagagggtggggacacacccaggctgggccacgcttcactctgtacacagaagcctcatacttctgtgcacagaactggggagtcaaagtgaggggctggacaatgtctggctctctgcaagctcccaagctggtaggaaagagaagacatagacaaaaaggacccatgctgccaagagaatgttccttttcctccccaagagaggtaggagacagtaggggcggctccaggcaggagggcttcacagagtgggtgtgtgtgaagcataagccacagttagtgggtgacaggtctttcagttttcctggagttttggatcaagatgaggctagaaagattaattggagccagctcccagagggcactgcacactgcgctgaggagctttggctatatccatttggcattagggagccagtgaaggttttggagctggggagtggcaagccagagctcactccttggggagacgtggctggctgcactgtgggtcacagcaggatgggggtggggcagctttgtggtgggatcctggccagctgactgggacaggagctgggcagcccaggtcctccctctgcccacccttcaaatttgggacctgaccaaagtgtttaaccctcgcgttgtgaggagaggtcaagggtttgggattctgagaagcccatcctggggtgggactgctttgacgggtcatcagcaaagcactcaccaaaaccacagatagcatccctagtgtgggcaggacttgggaccccacagctgtcctggagaggtccagaccatcccaccctcggggaggctgccgctttccctgggtgaggtgtggagctgctgtgagctgtcctcctccgagtccaggtggcatcacctccagctgctggaaatgccctgcctcttgccactctgtcacagcacccgccctggcctctgaagggagcctcctcgatcatcttcaatcccttcctgattgatcccaacgtgggtgccctgaagaggggccaccaagacggctgccaagaccatgcttggagagccctgtttgctcctcctcccagctggcacccaggcatctgttccaccaggagggaggcagctgctcccacagggcaccaggcagatgctggcagcacccgggaaacccaaggaagagagccccgaggttttgccccagcactgggccagcacagatgccaggacagtgtcttggccccggtgtaggctgagcatttcacttgactaaagggaacctttgccatttggcaacttctccatgctgggctttggcacctggagggcaaggcttctgtggcgagcgagggtgctgcttctaggaggtggttacgagccccaggttgtaccctgtggagcctcaggccaaaggcccagatgaccacgagtgcacatctcttgaccagaagtctttcatcaagcagcagcgagggggtctgcagagaggaaggtgctcttctgaggatcatctttgggaaagggcgctggcctgggcatgcaaggagcttcggggggtgagtgtgtgtcccagactgcttgggccactgtcttcctgcagcctgcagcaccggtctctgaagcaggaggatctacaggtagacctagggggatgtgggggcatgtttgtggacaccccattacatcttggtagattccatgtagtcacagtggctgcggttgtcctcggggcccggcaggggctgtcgagggacggtgggccggccatggcggaagctgtgcagggagaggcgcaaggagcccaggcgcttccagagccggagctggggctcactggggctcccagggtggtggggcatgcactcgtgagccctgcggcggctcgggtccagcgcggccggcttgcagagcgtcatgaacagcagacaggtggccagcaggaggaagatgcaggccagggcgatgagcatggggagggggtcagttgcctctgcaagggtcccgggagtgacgggagctgagagaaaggcgagggggctgatggctggggagctggcgaggctggggccctctgtgctcatggctcctgcaacagcaacaagacagaagctcaaaggcagatcagctggacccagggcagcgggtatagggaagacttacctagggaatgtggatgggggcaaggcactgttaaactggacagcatcatggccacatcacaggttaagacagcaaggtccagagacatcacaagtctaagtgtacacacagctgagcagtgatggagctgggcccaagctcaggccctcttcctgttccaccctgtgcccatctgccatgcagacaagagggcggtggcctgtccgcattttcaaatcaatcctcatgaatcatcacagggtcttaggcctggaaacttaagaccaactctgtcaataacttgctctgtggccaggaacgagttatggatggtaagaggccgcagctgccagggtccctagcagtaatctaataccaaagctgcaaactgggggcccacgggtgtgtttagttgggtccttgccatgtttttatcaatgtaattatgaatattttcaaaataataacagatttcacaaaaat

SEQ ID NO: 4048 - DNA, 2690 bp, Homo sapiens
ccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcagtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgaggtgagaagactaaggtacatgaaaaatagtaacttccctggtacaacaaagtcagtaagaaaaccaaaatttaagcccaagaaaccacattccagccagggtctgttcttgcatccccactgcgaaattgccttattcaatctgagtaatgtgaatctgtactctagagtttttcaaggggcagcccaagcatcttaaaaagtatcagattctcagaaatcctccctagaccattttccctctccctaaatttctatgtttacagaagcaactgaatacttccctacccaccaacatgctcctggctctcccctgcactgcttgctgctcttccacagcccttctctcatcctgacccctctgtctcatgtgcaccaccaagcttcttttgcttggcttgaaggtctgaacatccactctcaccttcatggtagcccaggctatttcatgatggtgacaccctcaagatccgtagaccactgtattagttcgttctcatgctgctaataaagatacccgagactgggtaatttatagaggaaa

SEQ ID NO: 4049 - DNA, 5428 bp, Homo sapiens
tacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcagtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtatgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctaggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacaccaaa

SEQ ID NO: 4050 - DNA, 4537 bp, Homo sapiens
catcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaaggctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtatgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctaggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacacc

SEQ ID NO: 4051 - DNA, 1629 bp, Homo sapiens
tgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagactgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagagcccccgacctgcaccggagatctcaggcacccggctcatctcagacctcccgctcccgaccctacacagagattgcctggggaggctgaggagccgatgcaaacccccaaggcgacgcacttgggagccggtggtctcaaacacctgccgggggtcctagtccccttctga

SEQ ID NO: 4052 - DNA, 2318 bp, Homo sapiens
agtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagactgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctgtggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaa

SEQ ID NO: 4053 - DNA, 3635 bp, Homo sapiens
attctggggctcgggggatcccggacaccctctcagctcctgcccgggggcccatgtgtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagactgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggcccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctgtggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcatctcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgtttt

SEQ ID NO: 4054 - DNA, 3489 bp, Homo sapiens
tgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagactgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggcccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctgtggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcatctcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagt

SEQ ID NO: 4055 - DNA, 2533 bp, Homo sapiens
agggagagaactctggaggaacgctgagctgagcagcaccgaggacagcgcccggcagcgcccgcgcccaggtctccctccgcagccctgactcgcgcacacgctgagcttttgctcactccccctcgcgcggacacagacacacgcatattcacacacccagacacacaccccgctgtacaatggcagaatcccacctgcagtcatccctcatcacagcctcacagtttttcgagatctggctccatttcgacgctgacggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataaccttaa

SEQ ID NO: 4056 - DNA, 1490 bp, Homo sapiens
aagaaacagatctgcagattatggatctcttactctatcaccaattattattgttgtgatgttgatgtagttggggagatgagaaaacatcttgtcctcactaagggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatg

SEQ ID NO: 4057 - DNA, 1466 bp, Homo sapiens
caaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaa

SEQ ID NO: 4058 - DNA, 1373 bp, Homo sapiens
gcacaaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttaccc

SEQ ID NO: 4059 - DNA, 7222 bp, Homo sapiens
agccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgtcctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 4060 - DNA, 7480 bp, Homo sapiens
ctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgtcctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 4061 - DNA, 2253 bp, Homo sapiens
gaacgagcctccgcggccatggcccggcgctcgccctagctccactgcacagatgccacggcggagccggcggggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttgggctgccgcccagagacaggcctcgggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagt

SEQ ID NO: 4062 - DNA, 1606 bp, Homo sapiens
ctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaa

SEQ ID NO: 4063 - DNA, 3696 bp, Homo sapiens
agcttcacagctgggagagcgcaggaaggcgccgggaaggaaagccagcccaccagcgtctgggtgggctgcgccgcgcggctggcggaccttcccgggttggagaagtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccagaataaatgattcccactgatccacccacttttgccaccccaggatgcaattttctggagagaagattagtggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 4064 - DNA, 3625 bp, Homo sapiens
agcttcacagctgggagagcgcaggaaggcgccgggaaggaaagccagcccaccagcgtctgggtgggctgcgccgcgcggctggcggaccttcccgggttggagaagtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 4065 - DNA, 1774 bp, Homo sapiens
agttataagagacaggaataccagtgagaagtatgagagagtgggtgggagataatgtttagaatctcttttgctgcccgcaatttatgaaaatggcttgaaaatatttatggtcaaagaccgaaatatttcttcaaagaagattagctttgctccattaaaagtaatgagtagaaatattaaaaaaaaaaaaagttttaagtacctgagtatcttgccagcaactgaccaccactgctaaaagtgaggagagacacagctttcatcattgggactgcagtttatttcaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgag

SEQ ID NO: 4066 - DNA, 1475 bp, Homo sapiens
atgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggccccagccttccacagagactaatctttcctttccctggccttctcatccggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttga

SEQ ID NO: 4067 - DNA, 3626 bp, Homo sapiens
gggctgcgccgcgcggctggcggaccttcccgggttggagaagtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccagaataaatgattcccactgatccacccacttttgccaccccaggatgcaattttctggagagaagattagtggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatctttt

SEQ ID NO: 4068 - DNA, 1523 bp, Homo sapiens
atgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggccccagccttccacagagactaatctttcctttccctggccttctcatccggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttga

SEQ ID NO: 4069 - DNA, 1741 bp, Homo sapiens
agcttcacagctgggagagcgcaggaaggcgccgggaaggaaagccagcccaccagcgtctgggtgggctgcgccgcgcggctggcggaccttcccgggttggagaagtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgag

SEQ ID NO: 4070 - DNA, 1502 bp, Homo sapiens
ttctaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattcttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctg

SEQ ID NO: 4071 - DNA, 5155 bp, Homo sapiens
acacagcctatgatctctctctgttcaggctgcttcttgctcttgtctcacaataagaaaggagtgctgctttcctggggtatgctatttgagaaagaaagtaacctaacactaactgcaggcggggtcagagtgatgtaacaggaagctctgatgtttcccttctgctgctgatcacttacaatctgacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgaattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctatatttggtaaatattttaaagacaaccagatgccagcatcagaagtctgtttgagaactaagagaacagaaacatctatcataagatatatttattttaaaaacacaaggtcactattttattgaatatatttgttttgataactcataccttaataataggtgtgtttgacatatttcttttttcattttgacaatgaactcacattctaatccagaaattttaaacaactactgtgataaataccaatctgctacttttatagattttaccccattaaaatattactttactgacttttactatgtgaagatatatagctttggaaatgtcccaggctattcaagaaatataaaaaactagaaggatactatatataccatatacaatgctttaatattttaatagagctactgtatataatacaaattagggaaatacttgaatatatcattgagaaaaaattattgtcagatcttactgaattattgtcagactttattaaataaagatagaagaaaaccttgctaatgaattaaagtgaaatttgcatgggattcagtttctctaatgttattttccgctgaaatctctaaagaacaagaatgacttcaattagtaaaagtcaattttgggaaaagtcatgggtatctgttttttaagtgtgtcaatctgattaaaatggatgaaacaaattactcatcataagttgtttcttaagctgtcaatatgtcaatagatggtgagttcagaacttatttcaaattgctaagacaaattatctaaattcgtaagaattaacatatagaatggtctggtcagtacatttataatttatctatgcatgaaaaagtattgttttgtttgaaacatgaatttcatagcaagctgccatagaaaggaacgcaggctgttctagaccttcaactgcctaaattatacaaaaattcattttaataaactcaattattagctatttattattcaaagacccatatttaaatcctttgctgaccatgttgacatatatcagccttcttctagacaaactgtcaactctcaaccatcttgacagtagaagtgacagtaaaaaatgttgaatgatcagagattatattaaaataaacatgtaattttcaagtatttttgttgtgcttttataatattaattctagatcagatttattttatagccagggtttgtctgttgtagagtcttgaggcgtagcagtcattcatgattaatcactgttagttttgtacccatatatttttagaatagttttaaatgttagatttctcaaaagctaaatgctacttaatatctttgtatcatactcataaagcaaagtaaatctgacactttttttaaagcaaacttctttgctgtcaaaaaaataaatttggggaaatttctagcttttaaaatgtagatctgcattttactgtgattacttgtgaaagtcatattttaattttctaaattctaatttgtcattttatttcctaaagttaatttccaatgcatttattcataaaatattcattctggaatgcagtgtttgtttaaatgtaatccaatgtatatagaattagtggtggctgtagtgctgtatttattgcttataattttttttaaatgtgaacttacttttaattttctcttggttttaatctgctagtagaaaccactagttatctgtaaaaatatattcaagatattctgatcaattataacaatttatgttatgcctagagtatatctctattttttgattgtatgaaaatattaaagttatgagttaaagtttattttcactgatatttactacagtgccaaataatctaatttataaacataattcttacagtaatcaatgggatacttctcaaaattaacaaatctcttaacaaaatatatcttttgccctctttaaagtcttcagtaaaccagtaaatgaattcaataaaccaa

SEQ ID NO: 4072 - DNA, 5223 bp, Homo sapiens
acacagcctatgatctctctctgttcaggctgcttcttgctcttgtctcacaataagaaaggagtgctgctttcctggggtatgctatttgagaaagaaagtaacctaacactaactgcaggcggggtcagagtgatgtaacaggaagctctgatgtttcccttctgctgctgatcacttacaatctgacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggggtcctacgatgatacaccaaccacttgtgctaccatctgtcaaaactttggatggccctactttcaggtcttgacccctgaatttaagaaattcttaaagacaatgtcaaatatgatccaagagaaaatgtgatttgagactggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgaattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctatatttggtaaatattttaaagacaaccagatgccagcatcagaagtctgtttgagaactaagagaacagaaacatctatcataagatatatttattttaaaaacacaaggtcactattttattgaatatatttgttttgataactcataccttaataataggtgtgtttgacatatttcttttttcattttgacaatgaactcacattctaatccagaaattttaaacaactactgtgataaataccaatctgctacttttatagattttaccccattaaaatattactttactgacttttactatgtgaagatatatagctttggaaatgtcccaggctattcaagaaatataaaaaactagaaggatactatatataccatatacaatgctttaatattttaatagagctactgtatataatacaaattagggaaatacttgaatatatcattgagaaaaaattattgtcagatcttactgaattattgtcagactttattaaataaagatagaagaaaaccttgctaatgaattaaagtgaaatttgcatgggattcagtttctctaatgttattttccgctgaaatctctaaagaacaagaatgacttcaattagtaaaagtcaattttgggaaaagtcatgggtatctgttttttaagtgtgtcaatctgattaaaatggatgaaacaaattactcatcataagttgtttcttaagctgtcaatatgtcaatagatggtgagttcagaacttatttcaaattgctaagacaaattatctaaattcgtaagaattaacatatagaatggtctggtcagtacatttataatttatctatgcatgaaaaagtattgttttgtttgaaacatgaatttcatagcaagctgccatagaaaggaacgcaggctgttctagaccttcaactgcctaaattatacaaaaattcattttaataaactcaattattagctatttattattcaaagacccatatttaaatcctttgctgaccatgttgacatatatcagccttcttctagacaaactgtcaactctcaaccatcttgacagtagaagtgacagtaaaaaatgttgaatgatcagagattatattaaaataaacatgtaattttcaagtatttttgttgtgcttttataatattaattctagatcagatttattttatagccagggtttgtctgttgtagagtcttgaggcgtagcagtcattcatgattaatcactgttagttttgtacccatatatttttagaatagttttaaatgttagatttctcaaaagctaaatgctacttaatatctttgtatcatactcataaagcaaagtaaatctgacactttttttaaagcaaacttctttgctgtcaaaaaaataaatttggggaaatttctagcttttaaaatgtagatctgcattttactgtgattacttgtgaaagtcatattttaattttctaaattctaatttgtcattttatttcctaaagttaatttccaatgcatttattcataaaatattcattctggaatgcagtgtttgtttaaatgtaatccaatgtatatagaattagtggtggctgtagtgctgtatttattgcttataattttttttaaatgtgaacttacttttaattttctcttggttttaatctgctagtagaaaccactagttatctgtaaaaatatattcaagatattctgatcaattataacaatttatgttatgcctagagtatatctctattttttgattgtatgaaaatattaaagttatgagttaaagtttattttcactgatatttactacagtgccaaataatctaatttataaacataattcttacagtaatcaatgggatacttctcaaaattaacaaatctcttaacaaaatatatcttttgccctctttaaagtcttcagtaaaccagtaaatgaattcaataaaccaa

SEQ ID NO: 4073 - DNA, 1984 bp, Homo sapiens
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcattttatgttatacagcatatttcattttggcttaatgatggagaaaaagtgtaccctgaattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcacc

SEQ ID NO: 4074 - DNA, 591 bp, Homo sapiens
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcatcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgaattttctggttctcttgcctttttttatgattcttgttacagcagaattagaagagagtcctgaggactcaattcagttgggagttactag

SEQ ID NO: 4075 - DNA, 642 bp, Homo sapiens
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggggtcctacgatgatacaccaaccacttgtgctaccatctgtcaaaactttggatggccctactttcaggtcttgacccctgaatttaagaaattcttaaagacaatgtcaaatatgatccaagagaaaatgtgatttgagactggagacaattgtgcattttatgttatacagcatatttcattttggcttaatgatggagaaaaagtgtaccctgaattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgt

SEQ ID NO: 4076 - DNA, 843 bp, Homo sapiens
ggcatcagagacactgcccagcccaagtgtcgccgccgcttccacagggctctggctggacgccgccgccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcagaactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaa

SEQ ID NO: 4077 - DNA, 477 bp, Homo sapiens
ccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcagaactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcataatcattgcccagaagagagcctgtga

SEQ ID NO: 4078 - DNA, 916 bp, Homo sapiens
ccgccgctgccaccgcctctgatccaagccacctcccgccaggtgagccccgagatcctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcagaactatgtgcagatgaaggccagtgagctggagcaggagcaagagagagagggctccagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttca

SEQ ID NO: 4079 - DNA, 581 bp, Homo sapiens
cgcctctgatccaagccacctcccgccaggtgagccccgagatcctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcagaactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctgg

SEQ ID NO: 4080 - DNA, 851 bp, Homo sapiens
agaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcagaactatgtgcagatgaaggccagtgagctggagcaggagcaagagagagagggctccagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaa

SEQ ID NO: 4081 - DNA, 1070 bp, Homo sapiens
gtaataagagcggggtctccgcggggaaggcgcccacagcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggttatcatgaaactgaactcaccatttctattaatttctgttggtaagaacttggtgagaatgccccgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgct

SEQ ID NO: 4082 - DNA, 2258 bp, Homo sapiens
gtcggccgcgaaggcgtggcggcccgcggaccggcggaccccgggtcataccagctgtccgggtgcacaggcccaggggccccacgaccgcgggtgtcgggaccgtgggctccactgaggagcccaccgaatccttcggcctggccaggcggggggtcttcttcccagtccgcggaagccaggtccgggagacggcggggctcactgtgccttcggacctacactctgctcgggggccggatttctgcaaagcgtccacttggaaagaagtttcacttgcagggaaggcgggtgtacgcaatgatggtccgtgtgtccgggatgtgaatgccaaccaagactgcgtccgttggtggagtgtgcgcgggtcctccgtgagggtgcttctggcagtcacagttcacgagttagcgagaagatggctgggaggcggcgagcccccgctcccggggcgcgcatttcgaactccataggtctcccgtggagagcagcccagacccggccacactcagtgaggaggaagtgcgcctcctgctggctgcactggtgcaggactatgtgcagatgaaggccagtgagctggagcaggagcaggagacagagctccagatttaatttatgtccttttcttctatcttctttggatggaggctgagtttcagttcttgccggagagtttccagatttctcctcctgatggcctgttctgtggattttggatttgccaaggcagccctcacaatccgagtcctggggctgtctaaggaactatggtgagatagagtgttatgggttgaattttgtccccctcaaaaaggtaccattgtcttctaaaagaacaactgaggagttcaacatgaaggaggaaggatatgtcattctttgcagtgacacaatcagaaaaggtactgctcccccacctaaatatgagggataagtgattttcagaagagacaggagaagaagggacaaatgtcctggtccttgtctccttgtcaacaaaagatgtactggtaccctttgaaaggggacagagaggatgccagctgaactgggagcactaagttctctgctttgtgaaaatgaatctgcaatgaactcctggtctttgtctggatgcccatctttctgcaagttgtcagcagaagcttttcaatgtggctacttggtgagttcacatacagcccaacccatagttctgatggagcctgaaaatcagccctgaaaagttctcctcagaggatgcctctgaagtgagaggcatgaaaaaagaggctaaccttcagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggttatcatgaaactgaactcaccatttctattaatttctgttggtaagaacttggtgagaatgccccgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgcttact

SEQ ID NO: 4083 - DNA, 2097 bp, Homo sapiens
gtaataagagcggggtctccgcggggaaggcgcccacagcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggtgtgtcctaaatccaatgacatatccttataagagattcactcagaagacacatgtggagaaggtgacatgacagaggcaaggaggcacaagccaaggaagtctgtgtctaccagaagccagaatcacagaacagtctctggaagaagagcagccctgctgacacctagagtttggacttccagcttccagaactgtgagagaataatttctgttgttttaagccacaaagtttgtggtaatttgttatgacagccctaggaaactaatacaatacattttcatttattttgggtaaatgccttggagtgggattgctgggttatttggaaagtgtgtatttaactctgtaagaaactgccaaactattttctgaagtgactgtaccacttcgccttcttgccagccacatatgagagctctagtatttccacaaataggtatgtagcagtatctcattgctgttttaatttgtatttccccaatgactaatgacgttgagcatctattttaccatatgtttatcacctttattgaagggtctgtttaaatcttctgctaaatttttgttggcttgcttgctttattagtgttgagtttttagagctctttatatgttgtggatgcaagattgttttcagatatatagtttggaaacttccttcccctgaatctgcggattgctttttcattttcttagcagtgtctctcacagagaaaaagttgtaatttgaataagatccaattcatctttttttttcttttatgtattgtgcttttagttcatgtctaagaactctttgcctaactaaggtcccaaggtcacaataaccttattctatactttcttgtaaaagttttatagttttatattttatatgtagattagtgatctattttgagttaatttttgtataaggtgagaggtgtaggttgaaattcatacctgtgaatatagatacccaattgtttcagtgccatttgttaaaaagactgttatttcaccatttaattgcccctgcacctttgtcaaaaagcaactgatcatatttgtgtgggtatatttctgggttctcaattctgtctcattgattgatttgaccattcttttgccaatgtcatactgccttgattagtgtagtgttaaagtgaatctcaaaaccaggtaatgtgggtctaccaacattgttcattcttgttcaaaaagattttagctacatctaaaatattttctacatcttttatacattttagaatcagtgtgttactatctacaaaatttctgatgagatttttaatgggattgtgttaaatcagtgggttaattttgggagaattagcatattaataatattaagtcgttcaattcatgaacacaatacatgttttcacttatttaggttttctctgtttttttttttttaacagtgttctcagttttcaacagaaatattctacacatatcttgttagatttttaactattttattttttggtgctaatgtaaatggtacttaaacatttttgtttttaattgttcattgctagtagatagaaatacaatatttaaaatatta
